US008481692B2

(12) United States Patent
Sidhu et al.

(10) Patent No.: US 8,481,692 B2
(45) Date of Patent: Jul. 9, 2013

(54) **COMPOSITIONS RELATING TO A MUTANT *CLOSTRIDIUM DIFFICILE* TOXIN AND METHODS THEREOF**

(75) Inventors: Maninder K. Sidhu, New City, NY (US); Annaliesa Sybil Anderson, Upper Saddle River, NJ (US); Robert G. K. Donald, South Orange, NJ (US); Kathrin Ute Jansen, Allendale, NJ (US); Narender K. Kalyan, Ridgewood, NJ (US); Justin Keith Moran, Valley Cottage, NY (US); Mark E. Ruppen, Garnerville, NY (US); Michael James Flint, Decatur, GA (US)

(73) Assignee: Wyeth LLC, Madison, NJ (US)

( * ) Notice: Subject to any disclaimer, the term of this patent is extended or adjusted under 35 U.S.C. 154(b) by 0 days.

(21) Appl. No.: 13/451,631

(22) Filed: Apr. 20, 2012

(65) Prior Publication Data
US 2012/0269841 A1  Oct. 25, 2012

Related U.S. Application Data

(60) Provisional application No. 61/478,474, filed on Apr. 22, 2011, provisional application No. 61/478,899, filed on Apr. 25, 2011.

(51) Int. Cl.
*A61K 39/08* (2006.01)
*C07K 14/00* (2006.01)

(52) U.S. Cl.
USPC ........ 530/409; 424/190.1; 424/450; 435/188; 514/103

(58) Field of Classification Search
None
See application file for complete search history.

(56) References Cited

U.S. PATENT DOCUMENTS

| 4,689,299 A | 8/1987 | Insel |
| 4,713,240 A | 12/1987 | Wilkins et al. |
| 5,231,003 A | 7/1993 | Coughlin et al. |
| 5,578,308 A | 11/1996 | Capiau et al. |

(Continued)

FOREIGN PATENT DOCUMENTS

| JP | 58216123 A | 12/1983 |
| WO | WO 94/13264 A1 | 6/1994 |

(Continued)

OTHER PUBLICATIONS

Pruitt, Rory N et al, The Journal of Biological Chemistry, vol. 284(33), pp. 219-21940, Aug. 14, 2009, Structure-function analysis of inositol Hexakisphosphate-induced autoprocessing in *Clostridium difficile* toxin A.*

(Continued)

*Primary Examiner* — Albert Navarro
*Assistant Examiner* — Ginny Portner
(74) *Attorney, Agent, or Firm* — Anna C. Chau

(57) ABSTRACT

In one aspect, the invention relates to an immunogenic composition that includes a mutant *Clostridium difficile* toxin A and/or a mutant *Clostridium difficile* toxin B. Each mutant toxin includes a glucosyltransferase domain having at least one mutation and a cysteine protease domain having at least one mutation, relative to the corresponding wild-type *C. difficile* toxin. The mutant toxins may further include at least one amino acid that is chemically crosslinked. In another aspect, the invention relates to antibodies or binding fragments thereof that binds to said immunogenic compositions. In further aspects, the invention relates to isolated nucleotide sequences that encode any of the foregoing, and methods of use of any of the foregoing compositions.

20 Claims, 46 Drawing Sheets

U.S. PATENT DOCUMENTS

| | | | |
|---|---|---|---|
| 5,610,023 | A | 3/1997 | Deutsch |
| 5,814,477 | A | 9/1998 | Williams et al. |
| 5,919,665 | A | 7/1999 | Williams |
| 6,083,512 | A | 7/2000 | Roberts |
| 6,299,881 | B1 | 10/2001 | Lees et al. |
| 6,667,035 | B1 | 12/2003 | von Eichel-Streiber |
| 6,680,168 | B2 | 1/2004 | Thomas et al. |
| 6,733,760 | B1 | 5/2004 | Wilkins et al. |
| 6,939,548 | B2 | 9/2005 | Wilkins et al. |
| 6,969,520 | B2 | 11/2005 | Thomas et al. |
| 7,151,159 | B2 | 12/2006 | von Eichel-Streiber |
| 7,226,597 | B2 | 6/2007 | Ballard et al. |
| 7,625,559 | B2 | 12/2009 | Ambrosino et al. |
| 7,750,204 | B2 | 7/2010 | Kodama et al. |
| 2004/0028705 | A1 | 2/2004 | Ballard et al. |
| 2004/0141986 | A1 | 7/2004 | Parizek et al. |
| 2006/0029608 | A1 | 2/2006 | Thomas et al. |
| 2007/0231336 | A1 | 10/2007 | Thomas et al. |
| 2009/0208948 | A1 | 8/2009 | Paquette et al. |
| 2010/0167320 | A1* | 7/2010 | Beernink et al. ............. 435/7.92 |
| 2011/0053244 | A1* | 3/2011 | Oyler et al. .................... 435/188 |
| 2012/0269841 | A1* | 10/2012 | Sidhu et al. ................. 424/190.1 |
| 2012/0276132 | A1* | 11/2012 | Feng et al. .................. 424/192.1 |
| 2013/0004561 | A1* | 1/2013 | Shone et al. .................. 424/450 |
| 2013/0005690 | A1* | 1/2013 | Savidge et al. ............... 514/103 |

FOREIGN PATENT DOCUMENTS

| | | | |
|---|---|---|---|
| WO | WO9612802 A1 | 5/1996 | |
| WO | WO9702835 A1 | 1/1997 | |
| WO | WO9702836 A1 | 1/1997 | |
| WO | WO9859053 A1 | 12/1998 | |
| WO | WO9920304 A1 | 4/1999 | |
| WO | WO0061761 A2 | 10/2000 | |
| WO | WO0061762 A1 | 10/2000 | |
| WO | WO0177319 A2 | 10/2001 | |
| WO | WO 03/000719 A2 * | 1/2003 | |
| WO | WO2005058353 A1 | 6/2005 | |
| WO | WO 2005/069913 A2 | 8/2005 | |
| WO | WO 2006/130925 A1 | 12/2006 | |
| WO | WO 2007/148091 A2 | 12/2007 | |
| WO | WO2009035707 A1 | 3/2009 | |
| WO | WO2009139919 A2 | 11/2009 | |
| WO | WO2009156852 A1 | 12/2009 | |
| WO | WO2010017383 A1 | 2/2010 | |
| WO | WO2010036826 A1 | 4/2010 | |
| WO | WO2010063693 A1 | 6/2010 | |
| WO | 2010/094970 A1 | 8/2010 | |
| WO | WO2011068953 A2 | 6/2011 | |
| WO | WO2012028741 A1 | 3/2012 | |
| WO | WO2012046061 A2 | 4/2012 | |

OTHER PUBLICATIONS

Prochazkova Katerina et al, The Journal of Biological Chemistry, vol. 284(39) pp. 26557-26568, Sep. 25, 2009, Structural and Molecular Mechanism for Autoprocessing of MARTX toxin of Vibrio cholerae at multiple sites.*

Tang, Hsin-Yao et al, Analytical Biochemistry, vol. 334, 2004, pp. 48-61.*

Abdiche et al, "Determining kinetics and affinities of protein interactions using a parallel real-time label-free biosensor, the Octet", Analytical Biochemistry, 377(2):209-217 (2008).

Aboudola et al, "*Clostridium difficile* Vaccine and Serum Immunoglobulin G Antibody Response to Toxin A", Infection and Immunity, 71(3):1608-1610 (2003).

Ackermann et al, "Cloning and Expression of *Clostridium difficile* Toxin A Gene (tcdA) by PCR Amplification and the Use of an Expression Vector", Abstracts of the Interscience Conference on Antimicrobial Agents & Chemotherapy, 43rd ICAAC, Session 80(B), Abstract # B805 (2003).

Aktories, "Self-Cutting to Kill: New Insights into the Processing of *Clostridium difficile* Toxins", ACS Chemical Biology, 2(4):228-230 (2007).

Albesa-Jove et al, "Four Distinct Structural Domains in *Clostridium difficile* Toxin B Visualized Using SAXS", J. Mol. Biol., 396(5):1260-1270 (2010).

Ananthakrishnan, "*Clostridium difficile* infection: epidemiology, risk factors and management", Nat. Rev. Gastroenterol. Hepatol, 8:17-26 (2011).

Antunes et al, "Molecular Methods to Study Transcriptional Regulation of *Clostridium difficile* Toxin Genes", Methods in Molecular Biology, 646:93-115 (2010).

Aoki et al, "Mode of Action of Botulinum Neurotoxins: Current Vaccination Strategies and Molecular Immune Recognition", Critical Reviews in Immunology, 30(2):167-187 (2010).

Aslam et al, "Treatment of *Clostridium difficile*-associated disease: old therapies and new strategies", The Lancet Infectious Diseases, 5(9):549-557 (2005).

Aunins et al, "Vaccine Production", The Biomedical Engineering Handbook: Second Edition, Ed. Joseph D. Bronzino, CRC Press LLC, 2000.

Babcock et al, "Human Monoclonal Antibodies Directed against Toxins A and B Prevent *Clostridium difficile*-Induced Mortality in Hamsters", Infection and Immunity, 74(11):6339-6347 (2006).

Banno et al, "Biochemical Characterization and Biologic Actions of Two Toxins (D-1 and D-2) from *Clostridium difficile*", Reviews of Infectious Diseases, 6(Supp. 1):S11-S20 (1984).

Barroso et al, "Mutagenesis of the *Clostridium difficile* toxin B gene and effect on cytotoxic activity", Microbial Pathogenesis, 16(4):297-303 (1994).

Bartlett, "Narrative Review: The New Epidemic of *Clostridium difficile*-Associated Enteric Disease", Annals of Internal Medicine, 145(10):758-764 (2006).

Bartlett, "*Clostridium difficile*: progress and challenges", Ann. N.Y. Acad. Sci., 1213:62-69 (2010).

Belyi et al, "Construction of a fusion protein carrying antigenic determinants of enteric clostridial toxins", FEMS Microbiology Letters, 225(2):325-329 (2003).

Bisseret et al, "*Clostridium difficile* Toxin B: Characterization and Sequence of Three Peptides", Journal of Chromatography, 490(1):91-100 (1989).

Bobak, "The Molecular Pathogenesis of *Clostridium difficile*-associated Disease", Current Infectious Disease Reports, 10(2):111-115 (2008).

Bobo et al, "Sporulation and Toxin Production in *Clostridium difficile*", Abstracts of the Annual Meeting of the American Society for Microbiology, B-67, p. 35 (1986).

Bokori-Brown et al, Molecular basis of toxicity of *Clostridium perfringens* epsilon toxin, The FEBS Journal 278 (3):4589-4601 (2011).

Braun et al, "Definition of the single integration site of the pathogenecity locus in *Clostridium difficile*", Gene, 181 (1-2):29-38 (1996).

Brown et al, "Construction and Characterization of Genetically Inactivated Pertussis Toxin", Symposium on Pertussis: Evaluation and Research on Acellular Pertussis Vaccines, Shizouka, Japan 1990, Develop. Biol. Standard., 73:63-73 (1991).

Burger et al, "Expression of recombinant *Clostridium difficile* toxin A using the Bacillus megaterium system", Biochemical and Biophysical Research Communications, 307(3):584-588 (2003).

Burns et al, "The diverse sporulation characteristics of *Clostridium difficile* clinical isolates are not associated with type", Anaerobe, 16(6):618-622 (2010).

Busch, "A Common Motif of Eukaryotic Glycosyltransferases is Essential for the Enzyme Activity of Large Clostridial Cytotoxins", The Journal of Biological Chemistry, 273(31):19566-19572 (1998).

Busch, "Involvement of a Conserved Tryptophan Residue in the UDP-Glucose Binding of Large Clostridial Cytotoxin Glycosyltransferases", The Journal of Biological Chemistry, 275(18):13228-13234 (2000).

Chabala et al, "Carbodiimide modification reduces the conductance and increases the tetrodotoxin sensitivity in batrachotoxin-modified sodium channels", Pflügers Arch. European Journal of Physiology 421(2-3):262-269 (1992).

Christodoulides et al, "Acellular pertussis vaccine prepared by a simple extraction and toxoiding procedure", Vaccine 5(3):199-207 (1987).

Christodoulides et al, "Optimal conditions for the toxoiding of pertussis toxin with 1-ethyl-3(3-dimethylaminopropyl) carbodiimide HC1", FEMS Microbiology Immunology 47:425-436 (1989).

Cohen et al, "Analysis of the Pathogenicity Locus in *Clostridium difficile* Strains", The Journal of Infectious Diseases, 181(2):659-663 (2000).

Coyle et al, "Reactivity of *Clostridium difficile* Toxinotypes with the illumigene™ *C. difficile* Molecular Assay" poster presented at the 110th General Meeting of the American Society for Microbiology, Poster Board No. 219, http://www.meridianbioscience.com/Content/Assets/Files/2.1%20%20C.%20difficile%20Products/illumigen%20C.%20difficile/illumigene%20technology%20page/ASM_Abstract_2.pdf—Date accessed Apr. 4, 2011.

Daubener et al, "*Clostridium difficile* Toxins A and B Inhibit Human Immune Response in Vitro", Infection and Immunity, 56(5):1107-1112 (1988).

Davis et al, "Antisera specificities to 1-ethyl-3-(3-dimethylaminopropyl) carbodiimide adducts of proteins", Immunology 53(3):435-41 (1984).

Demarest et al, "Neutralization of *Clostridium difficile* toxin A using antibody combinations", mAbs, 2(2):190-198 (2010).

Deneve et al, "New trends in *Clostridium difficile* virulence and pathogenesis", International Journal of Antimicrobial Agents, 33(S1):S24-S28 (2009).

Doern et al, "Laboratory Diagnosis of *Clostridium difficile*-Associated Gastrointestinal Disease: Comparison of a Monoclonal Antibody Enzyme Immunoassay for Toxins A and B with a Monoclonal Antibody Enzyme Immunoassay for Toxin A Only and Two Cytotoxicity Assays", Journal of Clinical Microbiology, 30(8):2042-2046 (1992).

Donta et al, "Effects of *Clostridium difficile* Toxin on Tissue-Cultured Cells", The Journal of Infectious Diseases, 141 (2):218-222 (1980).

Donta et al, "Differential Effects of *Clostridium difficile* Toxins on Tissue-Cultured Cells", Journal of Clinical Microbiology, 15(6):1157-1158 (1982).

Donta et al, "Recombinant Polypeptide of *C. difficile* Toxin B that Inhibits Toxin Activity", Abstracts of the 96th General Meeting of the American Society for Microbiology, B-22, p. 158 (1996).

Dupuy et al, "Regulated transcription of *Clostridium difficile* toxin genes", Molecular Microbiology, 27(1):107-120 (1998).

Ebright et al, "Evaluation of Eight Cephalosporins in Hamster Colitis Model", Antimicrobial Agents and Chemotherapy, 19(6):980-986 (1981).

Egerer et al, "Auto-catalytic Cleavage of *Clostridium difficile* Toxins A and B Depends on Cysteine Protease Activity", The Journal of Biological Chemistry, 282(35):25314-25321 (2007).

Egerer et al, "Autocatalytic Processing of *Clostridium difficile* Toxin B", The Journal of Biological Chemistry, 284 (6):3389-3395 (2009).

Faust et al, "The Enzymatic Domain of *Clostridium difficile* Toxin A is Located within its N-Terminal Region", Biochemical and Biophysical Research Communications, 251(1):100-105 (1998).

Fernie et al, "Active and Passive Immunization to Protect Against Antibiotic Associated Caecitis in Hamsters", International Symposium on Enteric Infections in Man and Animals: Standardization of Immunological Procedures, Dublin, Ireland, 1982, Develop. biol. Standard, 53:325-332 (1983).

Fluit et al, "Nontoxigenic Strains of *Clostridium difficile* Lack the Genes for Both Toxin A and Toxin B", Journal of Clinical Microbiology, 29(11):2666-2667 (1991).

Gardiner et al, "A DNA vaccine targeting the receptor-binding domain of *Clostridium difficile* toxin A", Vaccine, 27 (27):3598-3604 (2009).

Genisyuerek et al, "Structural determinants for membrane insertion, pore formation and translocation of *Clostridium difficile* toxin B", Molecular Microbiology 79(6):1643-1654 (2011).

Genth et al, "New Method to Generate Enzymatically Deficient *Clostridium difficile* Toxin B as an Antigen for Immunization", Infection and Immunity, 68(3):1094-1101 (2000).

Genth et al, "*Clostridium difficile* toxins: More than mere inhibitors of Rho proteins", The International Journal of Biochemistry & Cell Biology, 40(4):592-597 (2008).

Robinson et al, "Tetanus Toxin: The Effect of Chemical Modifications on Toxicity, Immunogenicity, and Conformation", The Journal of Biological Chemistry 250(18):7435-7442 (1975).

Woody et al, "Modification of Carboxyl Groups in Botulinum Neurotoxin Types A and E", Toxicon 27(10):1143-1150 (1989).

Anderson et al, "The Use of Esters of N-Hydroxysuccinimide in Peptide Synthesis", Journal of the American Chemical Society 86(9):1839-1842 (1964).

El-Faham et al, "Peptide Coupling Reagents, More than a Letter Soup", Chemical Reviews 111(11):6557-6602 (2011).

Kunkel et al, "Contact-site cross-linking agents", Molecular and Cellular Biochemistry 34(1):3-13 (1981).

Sheehan et al, "The Use of Water-Soluble and Basic Carbodiimides in Peptide Synthesis", The Journal of Organic Chemistry 21(4):439-441 (1956).

Gerding, "*Clostridium difficile* infection prevention: biotherapeutics, immunologics, and vaccines." Discov Med. Jan. 2012;13(68):75-83.

Lyerly et al, "Biological Activities of Toxins A and B of *Clostridium difficile*", Infection and Immunity, 35(3):1147-1150 (1982).

Lyerly et al, "Vaccination against Lethal *Clostridium difficile* Enterocolitis with a Nontoxic Recombinant Peptide of Toxin A", Current Microbiology, 21(1):29-32 (1990).

Lyras et al, "Toxin B is essential for virulence of *Clostridium difficile*", Nature, 458(7242):1176-1179 (2009).

Malorni et al, "Enhancement of Cell-Mediated Cytotoxicity by *Clostridium Difficile* Toxin A: An in Vitro Study", Toxicon, 29(4/5):417-428 (1991).

Mann et al, "Analysis of protein phosphorylation using mass spectrometry: deciphering the phosphoproteome", Trends in Biotechnology 20(6):261-268 (2002).

McMaster-Baxter and Musher, "*Clostridium difficile*: Recent Epidemiologic Findings and Advances in Therapy", Pharmacotherapy, 27(7):1029-1039 (2007).

Metz et al, "Physicochemical and immunochemical techniques predict the quality of diptheria toxoid vaccines", Vaccine, 22(2):156-167 (2003).

Metz et al, "Identification of Formaldehyde-induced Modifications in Proteins", The Journal of Biological Chemistry, 279(8):6235-6243 (2004).

Metz et al, "Identification of Formaldehyde-Induced Modifications in Proteins: Reactions with Insulin", Bioconjugate Chem. 17(3):815-822 (2006).

Metz et al, "Quality-control issues and approaches in vaccine development", Expert Rev. Vaccines 8(2):227-238 (2009).

Moncrief et al, "Genetic Characterization of Toxin A-Negative, Toxin B-Positive *Clostridium difficile* Isolates by PCR", Journal of Clinical Microbiology, 38(8):3072-3075 (2000).

Muldrow et al, "Molecular cloning of *Clostridium difficile* toxin A gene fragment in lambda gt11", FEBS Letters, 213 (2):249-253 (1987).

Nakajima et al, "Mechanism of Amide Formation by Carbodiimide for Bioconjugation in Aqueous Media", Bioconjugate Chem. 6(1):123-130 (1995).

Nencioni et al, "Characterization of Genetically Inactivated Pertussis Toxin Mutants: Candidates for a New Vaccine against Whooping Cough", Infection and Immunity, 58(5):1308-1315 (1990).

Nottrott et al, "*Clostridium difficile* toxin A-induced apoptosis is p53-independent but depends on glucosylation of Rho GTPases", Apoptosis, 12(8):1443-1453 (2007).

Paliwal et al, "Comparison of the Conformation, Hydrophobicity, and Model Membrane Interactions of Diphtheria Toxin to Those of Formaldehyde-Treated Toxin (Diphtheria Toxoid): Formaldehyde Stabilization of the Native Conformation Inhibits Changes That Allow Membrane Insertion", Biochemistry 35(7):2374-2379 (1996).

Pasut et al, "New active poly(ethylene glycol) derivative for amino coupling", Reactive & Functional Polymers 67 (6):529-539 (2007).

Pavliakova et al, "*Clostridium difficile* Recombinant Toxin A Repeating Units as a Carrier Protein for Conjugate Vaccines: Studies of Pneumococcal Type 14, *Escherichia coli* K1, and Shigella flexneri Type 2a Polysaccharides in Mice", Infection and Immunity, 68(4):2161-2166 (2000).

Phelps et al, "Construction and Expression of the Complete *Clostridium difficile* Toxin A Gene in *Escherichia coli*", Infection and Immunity, 59(1):150-153 (1991).
Pizza et al, "Mutants of Pertussis Toxin Suitable for Vaccine Development", Science 246(4929):497-500 (1989).
Price et al, "Cloning of the Carbohydrate-binding Portion of the Toxin A Gene of *Clostridium difficile*", Current Microbiology, 16(1):55-60 (1987).
Prigge, "The Development of Diphtheria Vaccines", Bull. Wld Hlth Org., 13(3):473-478 (1955).
Pruitt et al, "Structure-Function Analysis of Inositol Hexakisphosphate-induced Autoprocessing in *Clostridium difficile* Toxin A", The Journal of Biological Chemistry, 284(33):21934-21940 (2009).
Pruitt et al, "Structural organization of the functional domains of *Clostridium difficile* toxins A and B", PNAS, 107 (30):13467-13472 (2010).
Puri et al, "Rational Design of Inhibitors and Activity-Based Probes Targeting *Clostridium difficile* Virulence Factor TcdB", Chemistry & Biology, 17(11):1201-1211 (2010).
Qa'Dan et al, "pH-Induced Conformational Changes in *Clostridium difficile* Toxin B", Infection and Immunity 68 (5):2470-2474 (2000).
Rappuoli, "Toxin inactivation and antigen stabilization: two different uses of formaldehyde", Vaccine, 12(7):579-581 (1994).
Reineke et al, "Autocatalytic cleavage of *Clostridium difficile* toxin B", Nature, 446(7134):415-419 (2007).
Reinert et al, "Structural Basis for the Function of *Clostridium difficile* Toxin B", J. Mol. Biol., 351(5):973-981 (2005).
Rihn et al, "A New Purification Procedure for *Clostridium difficile* Enterotoxin", Biochemical and Biophysical Research Communications, 124(3):690-695 (1984).
Robbins et al, "The Diphtheria and Pertussis Components of Diphtheria-Tetanus Toxoids-Pertussis Vaccine Should be Genetically Inactivated Mutant Toxins", The Journal of Infectious Diseases 191(1):81-88 (2005).
Robbins et al, "The rise in pertussis cases urges replacement of chemically-inactivated with genetically-inactivated toxoid for DTP", Vaccine, 2515):2811-2816 (2007).
Roberts et al, "Modification of surface histidine residues abolishes the cytotoxic activity of *Clostridium difficile* toxin A", Toxicon, 39(2-3):325-333 (2001).
Rolfe et al, "Purification and Characterization of *Clostridium difficile* Toxin", Infection and Immunity, 25(1):191-201 (1979).
Rothman et al, "Differential Cytotoxic Effects of Toxins A and B Isolated from *Clostridium difficile*", Infection and Immunity, 46(2):324-331 (1984).
Rupnik et al, "Characterization of the cleavage site and function of resulting cleavage fragments after limited proteolysis of *Clostridium difficile* toxin B (TcdB) by host cells", Microbiology, 151:199-208 (2005).
Rupnik, "Heterogeneity of large clostridial toxins: importance of *Clostridium difficile* toxinotype", FEMS Microbiol Rev, 32(3):541-555 (2008).
Rupnik, "*Clostridium difficile* infection: new developments in epidemiology and pathogenesis", Nature, 7(7):526-536 (2009).
Sakurai et al, "Carboxyl groups in *Clostridium* perfringens epsilon toxin", Microbial Pathogenesis, 3(6):469-474 (1987).
Salcedo et al, "Intravenous immunoglobulin therapy for severe *Clostridium difficile* colitis", Gut, 41(3):366-370 (1997).
Salnikova et al, "Physical Characterization of *Clostridium difficile* Toxins and Toxoids: Effect of the Formaldehyde Crosslinking on Thermal Stability", Journal of Pharmaceutical Sciences 97(9):3735-3752 (2008).
Sambol et al, "Toxin Gene Analysis of a Variant Strain of *Clostridium difficile* That Causes Human Clinical Disease", Infection and Immunity, 68(10):5480-5487 (2000).
Sambol et al, "Infection of Hamsters with Epidemiologically Important Strains of *Clostridium difficile*", The Journal of Infectious Diseases, 183(12):1760-1766 (2001).
Sauerborn et al, "The C-terminal ligand-binding domain of *Clostridium difficile* toxin A (TcdA) abrogates TcdA-specific binding to cells and prevents mouse lethality", FEMS Microbiology Letters, 155(1):45-54 (1997).
Schmidt et al, "*Clostridium difficile* Toxin as a Confounding Factor in Enterovirus Isolation", Journal of Clinical Microbiology, 12(6):796-798 (1980).
Sebaihia et al, "The multidrug-resistant human pathogen *Clostridium difficile* has a highly mobile, mosaic genome", Nature Genetics, 38(7):779-786 (2006).
Shen et al, "Defining an allosteric circuit in the cysteine protease domain of *Clostridium difficile* toxins", Nature Structural & Molecular Biology, 18(3):364-372 (2011).
Smith, "Botulism and vaccines for its prevention", Vaccine, 27(Suppl 4):D33-D39 (2009).
Song et al, "Molecular analysis of the promoter region of the *Clostridium difficile* toxin B gene that is functional in *Escherichia coli*", J. Med. Microbiol., 47(4):309-316 (1998).
Sougioultzis et al, "*Clostridium difficile* Toxoid Vaccine in Recurrent *C. difficile*-Associated Diarrhea", Gastroenterology, 128(3):764-770 (2005).
Sougioultzis et al, "Bacterial infections: small intestine and colon", Current Opinion in Gastroenterology, 19 (1):23-30 (2003).
Spyres et al, "Deletion Analysis of the *Clostridium difficile* Toxin B Glucosylation Domain", Abstracts of the 101st General Meeting of the American Society for Microbiology, Session No. 156/B. Abstract B-238 (2001).
Spyres et al, "Mutational Analysis of the Enzymatic Domain of *Clostridium difficile* Toxin B Reveals Novel Inhibitors of the Wild-Type Toxin", Infection and Immunity, 71(6):3294-3301 (2003).
Stabler et al, "Comparative genome and phenotypic analysis of *Clostridium difficile* 027 strains provides insight into the evolution of a hypervirulent bacterium", Genome Biology, 10(9)Article R102:R102-R102.15 (2009).
Staros et al, "Enhancement by N-Hydroxysulfosuccinimide of Water-Soluble Carbodiimide-Mediated Coupling Reactions", Analytical Biochemistry 156(1):220-222 (1986).
Sun et al, "Essential role of the glucosyltransferase activity in *Clostridium difficile* toxin-induced secretion of TNF-α by macrophages", Microbial Pathogenesis, 46(6):298-305 (2009).
Tachovsky et al, "Toxin Production and Plasmid DNA in *Clostridium-difficile*", Abstracts of the Annual Meeting of the American Society for Microbiology, B134 (1984).
Tang et al, "One-Step Cloning and Expression of *Clostridium difficile* Toxin B Gene (tcdB)", Abstracts of the Interscience Conference on Antimicrobial Agents & Chemotherapy, 41st ICAAC Abstracts, Session 98(B), Abstract #B-970 (2001).
Tang-Feldman et al, "One-step cloning and expression of *Clostridium difficile* toxin B gene (tcdB)", Molecular and Cellular Probes, 16(3):179-183 (2002).
Taylor et al, "Comparison of Two Toxins Produced by *Clostridium difficile*", Infection and Immunity, 34(3):1036-1043 (1981).
Teichert et al, "Application of Mutated *Clostridium difficile* Toxin A for Determination of Glucosyltransferase-Dependent Effects", Infection and Immunity, 74(10):6006-6010 (2006).
Thaysen-Anderson et al, "Investigation of the detoxification mechanism of formaldehyde-treated tetanus toxin", Vaccine 25(12):2213-2227 (2007).
Thermo Scientific Pierce Crosslinking Technical Handbook, © 2009 Thermo Fisher Scientific Inc., www.piercenet.com/Files/1601673_Crosslink_HB_Intl.pdf, Date accessed Mar. 23, 2011.
Timkovich, "Detection of the Stable Addition of Carbodiimide to Proteins", Analytical Biochemistry 79(1-2):135-143 (1977).
Toma et al, "Serotyping of *Clostridium difficile*", Journal of Clinical Microbiology, 26(3):426-428 (1988).
Torres et al, "Evaluation of Formalin-Inactivated *Clostridium difficile* Vaccines Administered by Parenteral and Mucosal Routes of Immunization in Hamsters", Infection and Immunity, 63(12):4619-4627 (1995).
Torres et al, "Antigenicity of amino-acid sequences from *Clostridium difficile* toxin B", J. Med. Microbiol., 44 (6):464-474 (1996).
Torres et al, "*Clostridium difficile* Vaccine: Influence of Different Adjuvants and Routes of Immunization on Protective Immunity in Hamsters", Vaccine Research, 5(3):149-162 (1996).
Viswanathan et al, "*Clostridium difficile* infection—An Overview of the disease and its pathogenesis, epidemiology and interventions", Gut Microbes, 1(4):234-242 (2010).

von Eichel-Streiber et al, "Cloning and Characterization of Overlapping DNA Fragments of the Toxin A Gene of *Clostridium difficile*", Journal of General Microbiology, 135(1):55-64 (1989).

von Eichel-Streiber et al, "Cloning of *Clostridium difficile* toxin B gene and demonstration of high N-terminal homology between toxin A and B", Med Microbiol Immunol, 179(5):271-279 (1990).

von Eichel-Streiber et al, "A nonsense mutation abrogates production of a functional enterotoxin A in *Clostridium difficile* toxinotype VIII strains of serogroups F and X", FEMS Microbiology Letters, 178(1):163-168 (1999).

Voth et al, "*Clostridium difficile* Toxins: Mechanism of Action and Role in Disease", Clinical Microbiology Reviews, 18 (2):247-263 (2005).

Ward et al, "Immunogenicity of a Salmonella typhimurium aroA aroD Vaccine Expressing a Nontoxic Domain of *Clostridium difficile* Toxin A", Infection and Immunity, 67(5):2145-2152 (1999).

Ward et al, "Local and Systemic Neutralizing Antibody Responses Induced by Intranasal Immunization with the Nontoxic Binding Domain of Toxin A from *Clostridium difficile*", Infection and Immunity, 67(10):5124-4132 (1999).

Warny et al, "Human Antibody Response to *Clostridium difficile* Toxin A in Relation to Clinical Course of Infection", Infection and Immunity, 62(2):384-389 (1994).

Wilchek et al, "Limitations of N-Hydroxysuccinimide Esters in Affinity Chromatography and Protein Immobilization", Biochemistry 26(8):2155-2161 (1987).

Wilkins et al, "*Clostridium difficile* Testing: after 20 Years, Still Challenging", Journal of Clinical Microbiology, 41 (2):531-534 (2003).

Williamson et al, "Mass Spectrometric Analysis of Multiple Pertussis Toxins and Toxoids", Journal of Biomedicine and Biotechnology vol. 2010, Article ID 942365, 9 pages (2010).

Willis et al, "Confirmation that the Latex-Reactive Protein of *Clostridium difficile* Is a Glutamate Dehydogenase", Journal of Clinical Microbiology, 30(5)1363-1364 (1992).

Wolfhagen et al, "Toxins A and B of *Clostridium difficile*", FEMS Microbiology Reviews, 13(1):59-64 (1994).

Wren et al, "Molecular cloning and expression of *Clostridium difficile* toxin A in *Escherichia coli* K12", FEBS Letters, 225(1-2):82-86 (1987).

Yang et al, "Expression of recombinant *Clostridium difficile* toxin A and B in Bacillus megaterium", BMC Microbiology, 8:192 (2008).

Tian et al, "A novel fusion protein containing the receptor binding domains of *C. difficile* toxin A and toxin B elicits protective immunity against lethal toxin and spore challenge in preclinical efficacy models", Vaccine 30:4249-4258 (2012).

Fang et al, "Production of *Clostridium difficile* toxin in a medium totally free of both animal and dairy proteins or digests", Proc Natl Acad Sci USA, 106(32):13225-13229 (2009).

Gerding et al, "Treatment of *Clostridium difficile* Infection", Clinical Infectious Diseases, 46(Suppl1):S32-S42 (2008).

Gerding et al, "Advances in pathogenesis, diagnosis and management of CDI", Nat. Rev. Gastroenterol. Hepatol., 8(2):67-68 (2011).

Gerhard et al, "Comparison of wild type with recombinant *Clostridium difficile* toxin A", Microbial Pathogenesis, 38 (2-3):77-83 (2005).

Gersch et al, "Disarming *Clostridium difficile*", Chemistry & Biology, 17(11):1165-1166 (2010).

Ghose et al, "Transcutaneous Immunization with *Clostridium difficile* Toxoid A Induces Systemic and Mucosal Immune Responses and Toxin A-Neutralizing Antibodies in Mice", Infection and Immunity, 75(6):2826-2832 (2007).

Giannasca et al, "Active and passive immunization against *Clostridium difficile* diarrhea and colitis", Vaccine, 22 (7):848-856 (2004).

Giesemann et al, "Processing of *Clostridium difficile* Toxins", Journal of Medical Microbiology, 57:690-696 (2008).

Gouliouris et al, "Prevention and treatment of *Clostridium difficile* infection", Clinical Medicine, 11(1):75-79 (2011).

Grabarek et al, "Zero-Length Crosslinking Procedure with the Use of Active Esters", Analytical Biochemistry 185 (1):131-135 (1990).

Greenberg et al, "Phase I dose finding studies of an adjuvanted *Clostridium difficile* toxoid vaccine", Vaccine 30 (13):2245-2249 (2012).

Greenhill, "The importance of toxin A is re-established in *Clostridium difficile* infection", Nature Reviews: Gastroenterology & Hepatology, 7(12):654 (2010).

Greenspan et al, "Defining epitopes: It's not as easy as it seems", Nature Biotechnology, 17(10):936-937 (1999).

Gurwith et al, "Morphologic and functional effects of *Clostridium difficile* enterotoxin in tissue culture", Canadian Journal of Microbiology, 28(1):100-105 (1982).

Guttenberg et al, "Clostridial Glucosylating Toxins: Inositol Hexakisphosphate-Dependent Processing of *Clostridium sordellii* Lethal Toxin and *Clostridium novyi* α-Toxin", Journal of Biological Chemistry, 286 (17):14779-14786 (2011).

Haslam et al, "Growth of *Clostridium difficile* and production of toxins A and B in complex and defined media", J Med Microbiol, 21(4):293-297 (1986).

Heap et al, "The ClosTron: A universal gene knock-out system for the genus *Clostridium*", Journal of Microbiological Methods, 70(3):452-464 (2007).

Heap et al, "A modular system for *Clostridium* shuttle plasmids", Journal of Microbiological Methods≤, 78(1):79-85 (2009).

Hoare et al, "A Method for the Quantitative Modification and Estimation of Carboxylic Acid Groups in Proteins", The Journal of Biological Chemistry 242(10)2447-2453 (1967).

Hofmann et al, "Localization of the Glucosyltransferase Activity of *Clostridium difficile* Toxin B to the N-terminal Part of the Holotoxin", The Journal of Biological Chemistry, 272(17):11074-11078 (1997).

Holden et al, "Effects of *Helminthosporium maydis* Race T Toxin on Electron Transport in Susceptible Corn Mitochondria and Prevention of Toxin Actions by Dicyclohexylcarbodiimide", Plant Physiol. 91(4):1296-1302 (1989).

Hundsberger et al, "Transcription analysis of the genes tcdA-E of the pathogenicity locus of *Clostridium difficile*", Eur. J. Biochem., 244(3):735-742 (1997).

Hussack et al, "Neutralization of *Clostridium difficile* Toxin A with Single-Domain Antibodies Targeting the Cell-Receptor Binding Domain", Journal of Biological Chemistry, 286(11):8961-8976 (2011).

Jank et al, "Change of the Donor Substrate Specificity of *Clostridium difficile* Toxin B by Site-directed Mutagenesis", The Journal of Biological Chemistry, 280(45):37833-37838 (2005).

Jank et al, "*Clostridium difficile* Glucosyltransferase Toxin B-essential Amino Acids for Substrate Binding", The Journal of Biological Chemistry, 282(48):35222-35231 (2007).

Jank et al, "Structure and mode of action of clostridial glucosylating toxins: the ABCD model", Trends in Microbiology, 16(5):222-229 (2008).

Johnson, "Antibody Responses to Clostridial Infection in Humans", Clinical Infectious Diseases, 25(Suppl 2):S173-S177 (1997).

Jones et al, "An improved method for development of toxoid vaccines and antitoxins", Journal of Immunological Methods, 337(1):42-48 (2008).

Karberg et al, "Group II introns as controllable gene targeting vectors for genetic manipulation of bacteria", Nature Biotechnology, 19(2):1162-1167 (2001).

Karlsson et al, "Supression of Toxin Production in *C. difficile* by Amino Acids", Abstracts of the 99th General Meeting of the American Society for Microbiology, Session No. 55/Abstract L-4 (1999).

Kato et al, "Deletions in the repeating sequences of the toxin A gene of toxin A-negative, toxin B-positive *Clostridium difficile* strains", FEMS Microbiology Letters, 175(2):197-203 (1999).

Kayser et al, "Disruption of Bacterial Genes Using Retargeted Group II Introns", Sigma-Aldrich Poster, http://www.sigmaaldrich.com/etc/medialib/docs/Sigma/General_information/2/groupIIintronskarberg.pdf, Date accessed Sep. 12, 2010.

Kelly, "Immune response to *Clostridium difficile* infection", European Journal of Gastroenterology & Hepatology, 8 (11):1048-1053 (1996).

Kelly et al, "The host immune response to *Clostridium difficile*", Journal of Medical Microbiology, 60:1070-1079 (2011).

Ketley et al, "Sporogenesis and toxin A production by *Clostridium difficile*", J. Med. Microbiol., 22(1):33-38 (1986).

Kim et al, "Immunization of Adult Hamsters against *Clostridium difficile*-Associated Ileocecitis and Transfer of Protection to Infant Hamsters", Infection and Immunity, 55(12):2984-2992 (1987).

Kink et al, "Antibodies to Recombinant *Clostridium difficle* Toxins A and B Are an Effective Treatment and Prevent Relapse of *C. difficile*-Associated Disease in a Hamster Model of Infection", Infection and Immunity, 66(5):2018-2025 (1998).

Klipstein et al, "Development of a vaccine of cross-linked heat-stable and heat-labile enterotoxins that protects against *Escherichia coli* producing either enterotoxin", Infection and Immunity 37(2):550-557 (1982).

Kotloff et al, "Safety and Immunogenicity of Increasing Doses of a *Clostridium difficile* Toxoid Vaccine Administered to Healthy Adults", Infection and Immunity, 69(2): 988-995 (2001).

Kreimeyer et al, "Autoproteolytic cleavage mediates cytotoxicity of *Clostridium difficile* toxin A", Naunyn-Schmiedeberg's Archives of Pharmacology, 383(3):253-262 (2011).

Kuehne et al, "The role of toxin A and toxin B in *Clostridium difficile* infection", Nature, 467(7316):711-714 (2010).

Kyne et al, "Prospects for a Vaccine for *Clostridium difficile*", BioDrugs, 10(3):173-181 (1998).

Kyne et al, "Association between antibody response to toxin A and protection against recurrent *Clostridium difficile* diarrhoea", The Lancet, 357(9251):189-193 (2001).

Lancaster et al, "An assessment of thermal stability of *Clostridium difficile* toxoid formulations", Human Vaccines, 7 (2):202-210 (2011).

Lanis et al, "Variations in TcdB Activity and the Hypervirulence of Emerging Strains of *Clostridium difficile*", Plos Pathogens, 6(8):e1001061 (pp. 1-11) (2010).

Letourneur et al, "Molecular cloning, overexpression in *Escherichia coli*, and purification of 6x his-tagged C-terminal domain of *Clostridium difficile* toxins A and B", Protein Expression & Purification, 31(2):276-285 (2003).

Libby et al, "Production of Antitoxins to Two Toxins of *Clostridium difficile* and Immunological Comparison of the Toxins by Cross-Neutralization Studies", Infection and Immunity, 35(1):374-376 (1982).

Libby et al, "Effects of the Two Toxins of *Clostridium difficile* in Antibiotic-Associated Cecitis in Hamsters," Infection and Immunity, 36(2):822-829 (1982).

Lonnroth et al, "Toxin A of *Clostridium difficile*: Production, Purification and Effect in Mouse Intestine", Acta Pathologica, Microbiologica, et Immunologica Scandinavica—Section B, Microbiology, 91(6):395-400 (1983).

Lopez-Alonso et al, "Carbodiimide EDC Induces Cross-Links That Stabilize Rnase A C-Dimer against Dissociation: EDC Adducts Can Affect Protein Net Charge, Conformation, and Activity", Bioconjugate Chem. 20(8):1459-1473 (2009).

Lowy et al, "Treatment with Monoclonal Antibodies against *Clostridium difficile* Toxins", The New England Journal of Medicine, 362(3):197-205 (2010).

* cited by examiner

FIG. 1A

```
MSLISKEELIKLAYSIRPRENEYKTILTNLDEYNKLTTNNNENKYLQLKK 50
MSLISKEELIKLAYSIRPRENEYKTILTNLDEYNKLTTNNNENKYLQLKK 50
MSLISKEELIKLAYSIRPRENEYKTILTNLDEYNKLTTNNNENKYLQLKK 50
MSLISKEELIKLAYSIRPRENEYKTILTNLDEYNKLTTNNNENKYLQLKK 50
MSLISKEELIKLAYSIRPRENEYKTILTNLDEYNKLTTNNNENKYLQLKK 50
**************************************************

LNESIDVFMNKYKTSSRNRALSNLKKDILKEVILIKNSNTSPVEKNLHFV 100
LNESIDVFMNKYKTSSRNRALSNLKKDILKEVILIKNSNTSPVEKNLHFV 100
LNESIDVFMNKYKTSSRNRALSNLKKDILKEVILIKNSNTSPVEKNLHFV 100
LNESIDVFMNKYKNSSRNRALSNLKKDILKEVILIKNSNTSPVEKNLHFV 100
LNESIDVFMNKYKNSSRNRALSNLKKDILKEVILIKNSNTSPVEKNLHFV 100
*************.************************************

WIGGEVSDIALEYIKQWADINAEYNIKLWYDSEAFLVNTLKKAIVESSTT 150
WIGGEVSDIALEYIKQWADINAEYNIKLWYDSEAFLVNTLKKAIVESSTT 150
WIGGEVSDIALEYIKQWADINAEYNIKLWYDSEAFLVNTLKKAIVESSTT 150
WIGGEVSDIALEYIKQWADINAEYNIKLWYDSEAFLVNTLKKAIVESSTT 150
WIGGEVSDIALEYIKQWADINAEYNIKLWYDSEAFLVNTLKKAIVESSTT 150
**************************************************

EALQLLEEEIQNPQFDNMKFYKKRMEFIYDRQKRFINYYKSQINKPTVPT 200
EALQLLEEEIQNPQFDNMKFYKKRMEFIYDRQKRFINYYKSQINKPTVPT 200
EALQLLEEEIQNPQFDNMKFYKKRMEFIYDRQKRFINYYKSQINKPTVPT 200
EALQLLEEEIQNPQFDNMKFYKKRMEFIYDRQKRFINYYKSQINKPTVPT 200
EALQLLEEEIQNPQFDNMKFYKKRMEFIYDRQKRFINYYKSQINKPTVPT 200
**************************************************

IDDIIKSHLVSEYNRDETVLESYRTNSLRKINSNHGIDIRANSLFTEQEL 250
IDDIIKSHLVSEYNRDETVLESYRTNSLRKINSNHGIDIRANSLFTEQEL 250
IDDIIKSHLVSEYNRDETVLESYRTNSLRKINSNHGIDIRANSLFTEQEL 250
IDDIIKSHLVSEYNRDETLLESYRTNSLRKINSNHGIDIRANSLFTEQEL 250
IDDIIKSHLVSEYNRDETLLESYRTNSLRKINSNHGIDIRANSLFTEQEL 250
******************:*******************************

LNIYSQELLNRGNLAAASDIVRLLALKNFGGVYLDVDMLPGIHSDLFKTI 300
LNIYSQELLNRGNLAAASDIVRLLALKNFGGVYLAVAMLPGIHSDLFKTI 300
LNIYSQELLNRGNLAAASDIVRLLALKNFGGVYLDVDMLPGIHSDLFKTI 300
LNIYSQELLNRGNLAAASDIVRLLALKNFGGVYLDVDMLPGIHSDLFKTI 300
LNIYSQELLNRGNLAAASDIVRLLALKNFGGVYLDVDMLPGIHSDLFKTI 300
********************************** * *************

SRPSSIGLDRWEMIKLEAIMKYKKYINNYTSENFDKLDQQLKDNFKLIIE 350
SRPSSIGLDRWEMIKLEAIMKYKKYINNYTSENFDKLDQQLKDNFKLIIE 350
SRPSSIGLDRWEMIKLEAIMKYKKYINNYTSENFDKLDQQLKDNFKLIIE 350
PRPSSIGLDRWEMIKLEAIMKYKKYINNYTSENFDKLDQQLKDNFKLIIE 350
PRPSSIGLDRWEMIKLEAIMKYKKYINNYTSENFDKLDQQLKDNFKLIIE 350
.*************************************************
```

FIG. 1B

```
SKSEKSEIFSKLENLNVSDLEIKIAFALGSVINQALISKQGSYLTNLVIE 400
SKSEKSEIFSKLENLNVSDLEIKIAFALGSVINQALISKQGSYLTNLVIE 400
SKSEKSEIFSKLENLNVSDLEIKIAFALGSVINQALISKQGSYLTNLVIE 400
SKSEKSEIFSKLENLNVSDLEIKIAFALGSVINQALISKQGSYLTNLVIE 400
SKSEKSEIFSKLENLNVSDLEIKIAFALGSVINQALISKQGSYLTNLVIE 400
**************************************************

QVKNRYQFLNQHLNPAIESDNNFTDTTKIFHDSLFNSATAENSMFLTKIA 450
QVKNRYQFLNQHLNPAIESDNNFTDTTKIFHDSLFNSATAENSMFLTKIA 450
QVKNRYQFLNQHLNPAIESDNNFTDTTKIFHDSLFNSATAENSMFLTKIA 450
QVKNRYQFLNQHLNPAIESDNNFTDTTKIFHDSLFNSATAENSMFLTKIA 450
QVKNRYQFLNQHLNPAIESDNNFTDTTKIFHDSLFNSATAENSMFLTKIA 450
**************************************************

PYLQVGFMPEARSTISLSGPGAYASAYYDFINLQENTIEKTLKASDLIEF 500
PYLQVGFMPEARSTISLSGPGAYASAYYDFINLQENTIEKTLKASDLIEF 500
PYLQVGFMPEARSTISLSGPGAYASAYYDFINLQENTIEKTLKASDLIEF 500
PYLQVGFMPEARSTISLSGPGAYASAYYDFINLQENTIEKTLKASDLIEF 500
PYLQVGFMPEARSTISLSGPGAYASAYYDFINLQENTIEKTLKASDLIEF 500
**************************************************

KFPENNLSQLTEQEINSLWSFDQASAKYQFEKYVRDYTGGSLSEDNGVDF 550
KFPENNLSQLTEQEINSLWSFDQASAKYQFEKYVRDYTGGSLSEDNGVDF 550
KFPENNLSQLTEQEINSLWSFDQASAKYQFEKYVRDYTGGSLSEDNGVDF 550
KFPENNLSQLTEQEINSLWSFDQASAKYQFEKYVRDYTGGSLSEDNGVDF 550
KFPENNLSQLTEQEINSLWSFDQASAKYQFEKYVRDYTGGSLSEDNGVDF 550
**************************************************

NKNTALDKNYLLNNKIPSNNVEEAGSKNYVHYIIQLQGDDISYEATCNLF 600
NKNTALDKNYLLNNKIPSNNVEEAGSKNYVHYIIQLQGDDISYEATCNLF 600
NKNTALDKNYLLNNKIPSNNVEEAGSKNYVHYIIQLQGDDISYEATCNLF 600
NKNTALDKNYLLNNKIPSNNVEEAGSKNYVHYIIQLQGDDISYEATCNLF 600
NKNTALDKNYLLNNKIPSNNVEEAGSKNYVHYIIQLQGDDISYEATCNLF 600
**************************************************

SKNPKNSIIIQRNMNESAKSYFLSDDGESILELNKYRIPERLKNKEKVKV 650
SKNPKNSIIIQRNMNESAKSYFLSDDGESILELNKYRIPERLKNKEKVKV 650
SKNPKNSIIIQRNMNESAKSYFLSDDGESILELNKYRIPERLKNKEKVKV 650
SKNPKNSIIIQRNMNESAKSYFLSDDGESILELNKYRIPERLKNKEKVKV 650
SKNPKNSIIIQRNMNESAKSYFLSDDGESILELNKYRIPERLKNKEKVKV 650
**************************************************

TFIGHGKDEFNTSEFARLSVDSLSNEISSFLDTIKLDISPKNVEVNLLGC 700
TFIGHGKDEFNTSEFARLSVDSLSNEISSFLDTIKLDISPKNVEVNLLGA 700
TFIGHGKDEFNTSEFARLSVDSLSNEISSFLDTIKLDISPKNVEVNLLGC 700
TFIGHGKDEFNTSEFARLSVDSLSNEISSFLDTIKLDISPKNVEVNLLGC 700
TFIGHGKDEFNTSEFARLSVDSLSNEISSFLDTIKLDISPKNVEVNLLGC 700
************************************************* .
```

FIG. 1C

```
NMFSYDFNVEETYPGKLLLSIMDKITSTLPDVNKNSITIGANQYEVRINS    750
NMFSYDFNVEETYPGKLLLSIMDKITSTLPDVNKNSITIGANQYEVRINS    750
NMFSYDFNVEETYPGKLLLSIMDKITSTLPDVNKNSITIGANQYEVRINS    750
NMFSYDFNVEETYPGKLLLSIMDKITSTLPDVNKDSITIGANQYEVRINS    750
NMFSYDFNVEETYPGKLLLSIMDKITSTLPDVNKDSITIGANQYEVRINS    750
**************************************:**********

EGRKELLAHSGKWINKEEAIMSDLSSKEYIFFDSIDNKLKAKSKNIPGLA    800
EGRKELLAHSGKWINKEEAIMSDLSSKEYIFFDSIDNKLKAKSKNIPGLA    800
EGRKELLAHSGKWINKEEAIMSDLSSKEYIFFDSIDNKLKAKSKNIPGLA    800
EGRKELLAHSGKWINKEEAIMSDLSSKEYIFFDSIDNKLKAKSKNIPGLA    800
EGRKELLAHSGKWINKEEAIMSDLSSKEYIFFDSIDNKLKAKSKNIPGLA    800
**************************************************

SISEDIKTLLLDASVSPDTKFILNNLKLNIESSIGDYIYYEKLEPVKNII    850
SISEDIKTLLLDASVSPDTKFILNNLKLNIESSIGDYIYYEKLEPVKNII    850
SISEDIKTLLLDASVSPDTKFILNNLKLNIESSIGDYIYYEKLEPVKNII    850
SISEDIKTLLLDASVSPDTKFILNNLKLNIESSIGDYIYYEKLEPVKNII    850
SISEDIKTLLLDASVSPDTKFILNNLKLNIESSIGDYIYYEKLEPVKNII    850
**************************************************

HNSIDDLIDEFNLLENVSDELYELKKLNNLDEKYLISFEDISKNNSTYSV    900
HNSIDDLIDEFNLLENVSDELYELKKLNNLDEKYLISFEDISKNNSTYSV    900
HNSIDDLIDEFNLLENVSDELYELKKLNNLDEKYLISFEDISKNNSTYSV    900
HNSIDDLIDEFNLLENVSDELYELKKLNNLDEKYLISFEDISKNNSTYSV    900
HNSIDDLIDEFNLLENVSDELYELKKLNNLDEKYLISFEDISKNNSTYSV    900
**************************************************

RFINKSNGESVYVETEKEIFSKYSEHITKEISTIKNSIITDVNGNLLDNI    950
RFINKSNGESVYVETEKEIFSKYSEHITKEISTIKNSIITDVNGNLLDNI    950
RFINKSNGESVYVETEKEIFSKYSEHITKEISTIKNSIITDVNGNLLDNI    950
RFINKSNGESVYVETEKEIFSKYSEHITKEISTIKNSIITDVNGNLLDNI    950
RFINKSNGESVYVETEKEIFSKYSEHITKEISTIKNSIITDVNGNLLDNI    950
**************************************************

QLDHTSQVNTLNAAFFIQSLIDYSSNKDVLNDLSTSVKVQLYAQLFSTGL   1000
QLDHTSQVNTLNAAFFIQSLIDYSSNKDVLNDLSTSVKVQLYAQLFSTGL   1000
QLDHTSQVNTLNAAFFIQSLIDYSSNKDVLNDLSTSVKVQLYAQLFSTGL   1000
QLDHTSQVNTLNAAFFIQSLIDYSSNKDVLNDLSTSVKVQLYAQLFSTGL   1000
QLDHTSQVNTLNAAFFIQSLIDYSSNKDVLNDLSTSVKVQLYAQLFSTGL   1000
**************************************************

NTIYDSIQLVNLISNAVNDTINVLPTITEGIPIVSTILDGINLGAAIKEL   1050
NTIYDSIQLVNLISNAVNDTINVLPTITEGIPIVSTILDGINLGAAIKEL   1050
NTIYDSIQLVNLISNAVNDTINVLPTITEGIPIVSTILDGINLGAAIKEL   1050
NTIYDSIQLVNLISNAVNDTINVLPTITEGIPIVSTILDGINLGAAIKEL   1050
NTIYDSIQLVNLISNAVNDTINVLPTITEGIPIVSTILDGINLGAAIKEL   1050
**************************************************
```

FIG. 1D

```
LDEHDPLLKKELEAKVGVLAINMSLSIAATVASIVGIGAEVTIFLLPIAG  1100
LDEHDPLLKKELEAKVGVLAINMSLSIAATVASIVGIGAEVTIFLLPIAG  1100
LDEHDPLLKKELEAKVGVLAINMSLSIAATVASIVGIGAEVTIFLLPIAG  1100
LDEHDPLLKKELEAKVGVLAINMSLSIAATVASIVGIGAEVTIFLLPIAG  1100
LDEHDPLLKKELEAKVGVLAINMSLSIAATVASIVGIGAEVTIFLLPIAG  1100
**************************************************

ISAGIPSLVNNELILHDKATSVVNYFNHLSESKKYGPLKTEDDKILVPID  1150
ISAGIPSLVNNELILHDKATSVVNYFNHLSESKKYGPLKTEDDKILVPID  1150
ISAGIPSLVNNELILHDKATSVVNYFNHLSESKKYGPLKTEDDKILVPID  1150
ISAGIPSLVNNELILHDKATSVVNYFNHLSESKKYGPLKTEDDKILVPID  1150
ISAGIPSLVNNELILHDKATSVVNYFNHLSESKEYGPLKTEDDKILVPID  1150
********************************:*****************

DLVISEIDFNNNSIKLGTCNILAMEGGSGHTVTGNIDHFFSSPSISSHIP  1200
DLVISEIDFNNNSIKLGTCNILAMEGGSGHTVTGNIDHFFSSPSISSHIP  1200
DLVISEIDFNNNSIKLGTCNILAMEGGSGHTVTGNIDHFFSSPSISSHIP  1200
DLVISEIDFNNNSIKLGTCNILAMEGGSGHTVTGNIDHFFSSPYISSHIP  1200
DLVISEIDFNNNSIKLGTCNILAMEGGSGHTVTGNIDHFFSSPYISSHIP  1200
******************************************* ******

SLSIYSAIGIETENLDFSKKIMMLPNAPSRVFWWETGAVPGLRSLENDGT  1250
SLSIYSAIGIETENLDFSKKIMMLPNAPSRVFWWETGAVPGLRSLENDGT  1250
SLSIYSAIGIETENLDFSKKIMMLPNAPSRVFWWETGAVPGLRSLENDGT  1250
SLSVYSAIGIKTENLDFSKKIMMLPNAPSRVFWWETGAVPGLRSLENNGT  1250
SLSVYSAIGIKTENLDFSKKIMMLPNAPSRVFWWETGAVPGLRSLENNGT  1250
***:******:*********************************:**

RLLDSIRDLYPGKFYWRFYAFFDYAITTLPVYEDTNIKIKLDKDTRNFI  1300
RLLDSIRDLYPGKFYWRFYAFFDYAITTLPVYEDTNIKIKLDKDTRNFI  1300
RLLDSIRDLYPGKFYWRFYAFFDYAITTLPVYEDTNIKIKLDKDTRNFI  1300
KLLDSIRDLYPGKFYWRFYAFFDYAITTLPVYEDTNTKIKLDKDTRNFI  1300
KLLDSIRDLYPGKFYWRFYAFFDYAITTLPVYEDTNTKIKLDKDTRNFI  1300
:***********************************  ***********

MPTITTNEIRNKLSYSFDGAGGTYSLLLSSYPISTNINLSKDDLWIFNID  1350
MPTITTNEIRNKLSYSFDGAGGTYSLLLSSYPISTNINLSKDDLWIFNID  1350
MPTITTNEIRNKLSYSFDGAGGTYSLLLSSYPISTNINLSKDDLWIFNID  1350
MPTITTDEIRNKLSYSFDGAGGTYSLLLSSYPISMNINLSKDDLWIFNID  1350
MPTITTDEIRNKLSYSFDGAGGTYSLLLSSYPISMNINLSKDDLWIFNID  1350
******:***************************  **************

NEVREISIENGTIKKGKLIKDVLSKIDINKNKLIIGNQTIDFSGDIDNKD  1400
NEVREISIENGTIKKGKLIKDVLSKIDINKNKLIIGNQTIDFSGDIDNKD  1400
NEVREISIENGTIKKGKLIKDVLSKIDINKNKLIIGNQTIDFSGDIDNKD  1400
NEVREISIENGTIKKGNLIEDVLSKIDINKNKLIIGNQTIDFSGDIDNKD  1400
NEVREISIENGTIKKGNLIEDVLSKIDINKNKLIIGNQTIDFSGDIDNKD  1400
****************:**:******************************
```

FIG. 1E

```
RYIFLTCELDDKISLIIEINLVAKSYSLLLSGDKNYLISNLSNIIEKINT  1450
RYIFLTCELDDKISLIIEINLVAKSYSLLLSGDKNYLISNLSNIIEKINT  1450
RYIFLTCELDDKISLIIEINLVAKSYSLLLSGDKNYLISNLSNTIEKINT  1450
RYIFLTCELDDKISLIIEINLVAKSYSLLLSGDKNYLISNLSNTIEKINT  1450
RYIFLTCELDDKISLIIEINLVAKSYSLLLSGDKNYLISNLSNTIEKINT  1450
************************************** ******

LGLDSKNIAYNYTDESNNKYFGAISKTSQKSIIHYKKDSKNILEFYNDST  1500
LGLDSKNIAYNYTDESNNKYFGAISKTSQKSIIHYKKDSKNILEFYNDST  1500
LGLDSKNIAYNYTDESNNKYFGAISKTSQKSIIHYKKDSKNILEFYNDST  1500
LGLDSKNIAYNYTDESNNKYFGAISKTSQKSIIHYKKDSKNILEFYNGST  1500
LGLDSKNIAYNYTDESNNKYFGAISKTSQKSIIHYKKDSKNILEFYNGST  1500
*********************************************.**

LEFNSKDFIAEDINVFMKDDINTITGKYYVDNNTDKSIDFSISLVSKNQV  1550
LEFNSKDFIAEDINVFMKDDINTITGKYYVDNNTDKSIDFSISLVSKNQV  1550
LEFNSKDFIAEDINVFMKDDINTITGKYYVDNNTDKSIDFSISLVSKNQV  1550
LEFNSKDFIAEDINVFMKDDINTITGKYYVDNNTDKSIDFSISLVSKNQV  1550
LEFNSKDFIAEDINVFMKDDINTITGKYYVDNNTDKSIDFSISLVSKNQV  1550
**************************************************

KVNGLYLNESVYSSYLDFVKNSDGHHNTSNFMNLFLDNISFWKLFGFENI  1600
KVNGLYLNESVYSSYLDFVKNSDGHHNTSNFMNLFLDNISFWKLFGFENI  1600
KVNGLYLNESVYSSYLDFVKNSDGHHNTSNFMNLFLDNISFWKLFGFENI  1600
KVNGLYLNESVYSSYLDFVKNSDGHHNTSNFMNLFLNNISFWKLFGFENI  1600
KVNGLYLNESVYSSYLDFVKNSDGHHNTSNFMNLFLNNISFWKLFGFENI  1600
************************************.*************

NFVIDKYFTLVGKTNLGYVEFICDNNKNIDIYFGEWKTSSSKSTIFSGNG  1650
NFVIDKYFTLVGKTNLGYVEFICDNNKNIDIYFGEWKTSSSKSTIFSGNG  1650
NFVIDKYFTLVGKTNLGYVEFICDNNKNIDIYFGEWKTSSSKSTIFSGNG  1650
NFVIDKYFTLVGKTNLGYVEFICDNNKNIDIYFGEWKTSSSKSTIFSGNG  1650
NFVIDKYFTLVGKTNLGYVEFICDNNKNIDIYFGEWKTSSSKSTIFSGNG  1650
**************************************************

RNVVVEPIYNPDTGEDISTSLDFSYEPLYGIDRYINKVLIAPDLYTSLIN  1700
RNVVVEPIYNPDTGEDISTSLDFSYEPLYGIDRYINKVLIAPDLYTSLIN  1700
RNVVVEPIYNPDTGEDISTSLDFSYEPLYGIDRYINKVLIAPDLYTSLIN  1700
RNVVVEPIYNPDTGEDISTSLDFSYEPLYGIDRYINKVLIAPDLYTSLIN  1700
RNVVVEPIYNPDTGEDISTSLDFSYEPLYGIDRYINKVLIAPDLYTSLIN  1700
**************************************************

INTNYYSNEYYPEIIVLNPNTFHKKVNINLDSSSFEYKWSTEGSDFILVR  1750
INTNYYSNEYYPEIIVLNPNTFHKKVNINLDSSSFEYKWSTEGSDFILVR  1750
INTNYYSNEYYPEIIVLNPNTFHKKVNINLDSSSFEYKWSTEGSDFILVR  1750
INTNYYSNEYYPEIIVLNPNTFHKKVNINLDSSSFEYKWSTEGSDFILVR  1750
INTNYYSNEYYPEIIVLNPNTFHKKVNINLDSSSFEYKWSTEGSDFILVR  1750
**************************************************
```

FIG. 1F

```
YLEESNKKILQKIRIKGILSNTQSFNKMSIDFKDIKKLSLGYIMSNFKSF 1800
YLEESNKKILQKIRIKGILSNTQSFNKMSIDFKDIKKLSLGYIMSNFKSF 1800
YLEESNKKILQKIRIKGILSNTQSFNKMSIDFKDIKKLSLGYIMSNFKSF 1800
YLEESNKKILQKIRIKGILSNTQSFNKMSIDFKDIKKLSLGYIMSNFKSF 1800
YLEESNKKILQKIRIKGILSNTQSFNKMSIDFKDIKKLSLGYIMSNFKSF 1800
**************************************************

NSENELDRDHLGFKIIDNKTYYDEDSKLVKGLININNSLFYFDPIEFNL 1850
NSENELDRDHLGFKIIDNKTYYDEDSKLVKGLININNSLFYFDPIEFNL 1850
NSENELDRDHLGFKIIDNKTYYDEDSKLVKGLININNSLFYFDPIEFNL 1850
NSENELDRDHLGFKIIDNKTYYDEDSKLVKGLININNSLFYFDPIESNL 1850
NSENELDRDHLGFKIIDNKTYYDEDSKLVKGLININNSLFYFDPIESNL 1850
***********************************************  **

VTGWQTINGKKYYFDINTGAALISYKIINGKHFYFNNDGVMQLGVFKGPD 1900
VTGWQTINGKKYYFDINTGAALISYKIINGKHFYFNNDGVMQLGVFKGPD 1900
VTGWQTINGKKYYFDINTGAALTSYKIINGKHFYFNNDGVMQLGVFKGPD 1900
VTGWQTINGKKYYFDINTGAASTSYKIINGKHFYFNNNGVMQLGVFKGPD 1900
VTGWQTINGKKYYFDINTGAASTSYKIINGKHFYFNNNGVMQLGVFKGPD 1900
**********************   *******************:************

GFEYFAPANTQNNNIEGQAIVYQSKFLTLNGKKYYFDNDSKAVTGWRIIN 1950
GFEYFAPANTQNNNIEGQAIVYQSKFLTLNGKKYYFDNDSKAVTGWRIIN 1950
GFEYFAPANTQNNNIEGQAIVYQSKFLTLNGKKYYFDNDSKAVTGWRIIN 1950
GFEYFAPANTQNNNIEGQAIVYQSKFLTLNGKKYYFDNDSKAVTGWRIIN 1950
GFEYFAPANTQNNNIEGQAIVYQSKFLTLNGKKYYFDNDSKAVTGWRIIN 1950
***********************************:************

NEKYYFNPNNAIAAVGLQVIDNNKYYFNPDTAIISKGWQTVNGSRYYFDT 2000
NEKYYFNPNNAIAAVGLQVIDNNKYYFNPDTAIISKGWQTVNGSRYYFDT 2000
NEKYYFNPNNAIAAVGLQVIDNNKYYFNPDTAIISKGWQTVNGSRYYFDT 2000
NEKYYFNPNNAIAAVGLQVIDNNKYYFNPDTAIISKGWQTVNGSRYYFDT 2000
NEKYYFNPNNAIAAVGLQVIDNNKYYFNPDTAIISKGWQTVNGSRYYFDT 2000
**************************************************

DTAIAFNGYKTIDGKHFYFDSDCVVKIGVFSTSNGFEYFAPANTYNNNIE 2050
DTAIAFNGYKTIDGKHFYFDSDCVVKIGVFSTSNGFEYFAPANTYNNNIE 2050
DTAIAFNGYKTIDGKHFYFDSDCVVKIGVFSTSNGFEYFAPANTYNNNIE 2050
DTAIAFNGYKTIDGKHFYFDSDCVVKIGVFSGSNGFEYFAPANTYNNNIE 2050
DTAIAFNGYKTIDGKHFYFDSDCVVKIGVFSGSNGFEYFAPANTYNNNIE 2050
******************************* ******************

GQAIVYQSKFLTLNGKKYYFDNNSKAVTGWQTIDSKKYYFNTNTAEAATG 2100
GQAIVYQSKFLTLNGKKYYFDNNSKAVTGWQTIDSKKYYFNTNTAEAATG 2100
GQAIVYQSKFLTLNGKKYYFDNNSKAVTGLQTIDSKKYYFNTNTAEAATG 2100
GQAIVYQSKFLTLNGKKYYFDNNSKAVTGWQTIDSKKYYFNTNTAEAATG 2100
GQAIVYQSKFLTLNGKKYYFDNNSKAVTGWQTIDSKKYYFNTNTAEAATG 2100
*****************************  *******************
```

FIG. 1G

```
WQTIDGKKYYFNTNTAEAATGWQTIDGKKYYFNTNTAIASTGYTIINGKH  2150
WQTIDGKKYYFNTNTAEAATGWQTIDGKKYYFNTNTAIASTGYTIINGKH  2150
WQTIDGKKYYFNTNTAEAATGWQTIDGKKYYFNTNTAIASTGYTIINGKH  2150
WQTIDGKKYYFNTNTAEAATGWQTIDGKKYYFNTNTSIASTGYTIINGKY  2150
WQTIDGKKYYFNTNTAEAATGWQTIDGKKYYFNTNTSIASTGYTIINGKY  2150
**********************************:************:

FYFNTDGIMQIGVFKGPNGFEYFAPANTDANNIEGQAILYQNEFLTLNGK  2200
FYFNTDGIMQIGVFKGPNGFEYFAPANTDANNIEGQAILYQNEFLTLNGK  2200
FYFNTDGIMQIGVFKGPNGFEYFAPANTDANNIEGQAILYQNEFLTLNGK  2200
FYFNTDGIMQIGVFKVPNGFEYFAPANTHNNNIEGQAILYQNKFLTLNGK  2200
FYFNTDGIMQIGVFKVPNGFEYFAPANTHNNNIEGQAILYQNKFLTLNGK  2200
***************.************.****************:****

KYYFGSDSKAVTGWRIINNKKYYFNPNNAIAAIHLCTINNDKYYFSYDGI  2250
KYYFGSDSKAVTGWRIINNKKYYFNPNNAIAAIHLCTINNDKYYFSYDGI  2250
KYYFGSDSKAVTGWRIINNKKYYFNPNNAIAAIHLCTINNDKYYFSYDGI  2250
KYYFGSDSKAITGWQTIDGKKYYFNPNNAIAATHLCTINNDKYYFSYDGI  2250
KYYFGSDSKAITGWQTIDGKKYYFNPNNAIAATHLCTINNDKYYFSYDGI  2250
**********:***: *:.**************  ***************

LQNGYITIERNNFYFDANNESKMVTGVFKGPNGFEYFAPANTHNNNIEGQ  2300
LQNGYITIERNNFYFDANNESKMVTGVFKGPNGFEYFAPANTHNNNIEGQ  2300
LQNGYITIERNNFYFDANNESKMVTGVFKGPNGFEYFAPANTHNNNIEGQ  2300
LQNGYITIERNNFYFDANNESKMVTGVFKGPNGFEYFAPANTHNNNIEGQ  2300
LQNGYITIERNNFYFDANNESKMVTGVFKGPNGFEYFAPANTHNNNIEGQ  2300
*************************************************

AIVYQNKFLTLNGKKYYFDNDSKAVTGWQTIDGKKYYFNLNTAEAATGWQ  2350
AIVYQNKFLTLNGKKYYFDNDSKAVTGWQTIDGKKYYFNLNTAEAATGWQ  2350
AIVYQNKFLTLNGKKYYFDNDSKAVTGWQTIDGKKYYFNLNTAEAATGWQ  2350
AIVYQNKFLTLNGKKYYFDNDSKAVTGWQTIDSKKYYFNLNTAVAVTGWQ  2350
AIVYQNKFLTLNGKKYYFDNDSKAVTGWQTIDSKKYYFNLNTAVAVTGWQ  2350
*******************************.**********  *.****

TIDGKKYYFNLNTAEAATGWQTIDGKKYYFNTNTFIASTGYTSINGKHFY  2400
TIDGKKYYFNLNTAEAATGWQTIDGKKYYFNTNTFIASTGYTSINGKHFY  2400
TIDGKKYYFNLNTAEAATGWQTIDGKKYYFNTNTFIASTGYTSINGKHFY  2400
TIDGEKYYFNLNTAEAATGWQTIDGKRYYFNTNTYIASTGYTIINGKHFY  2400
TIDGEKYYFNLNTAEAATGWQTIDGKRYYFNTNTYIASTGYTIINGKHFY  2400
****:***************** ****:*****:******* *******

FNTDGIMQIGVFKGPNGFEYFAPANTHNNNIEGQAILYQNKFLTLNGKKY  2450
FNTDGIMQIGVFKGPNGFEYFAPANTHNNNIEGQAILYQNKFLTLNGKKY  2450
FNTDGIMQIGVFKGPNGFEYFAPANTDANNIEGQAILYQNKFLTLNGKKY  2450
FNTDGIMQIGVFKGPDGFEYFAPANTHNNNIEGQAILYQNKFLTLNGKKY  2450
FNTDGIMQIGVFKGPDGFEYFAPANTHNNNIEGQAILYQNKFLTLNGKKY  2450
***************.*********:***.*******************
```

FIG. 1H

```
YFGSDSKAVTGLRTIDGKKYYFNTNTAVAVTGWQTINGKKYYFNTNTSIA  2500
YFGSDSKAVTGLRTIDGKKYYFNTNTAVAVTGWQTINGKKYYFNTNTSIA  2500
YFGSDSKAVTGLRTIDGKKYYFNTNTAVAVTGWQTINGKKYYFNTNTSIA  2500
YFGSDSKAVTGLRTIDGKKYYFNTNTAVAVTGWQTINGKKYYFNTNTYIA  2500
YFGSDSKAVTGLRTIDGKKYYFNTNTAVAVTGWQTINGKKYYFNTNTYIA  2500
************************************************ **

STGYTIISGKHFYFNTDGIMQIGVFKGPDGFEYFAPANTDANNIEGQAIR  2550
STGYTIISGKHFYFNTDGIMQIGVFKGPDGFEYFAPANTDANNIEGQAIR  2550
STGYTIISGKHFYFNTDGIMQIGVFKGPDGFEYFAPANTDANNIEGQAIR  2550
STGYTIISGKHFYFNTDGIMQIGVFKGPDGFEYFAPANTDANNIEGQAIR  2550
STGYTIISGKHFYFNTDGIMQIGVFKGPDGFEYFAPANTDANNIEGQAIR  2550
**************************************************

YQNRFLYLHDNIYYFGNNSKAATGWVTIDGNRYYFEPNTAMGANGYKTID  2600
YQNRFLYLHDNIYYFGNNSKAATGWVTIDGNRYYFEPNTAMGANGYKTID  2600
YQNRFLYLHDNIYYFGNNSKAATGWVTIDGNRYYFEPNTAMGANGYKTID  2600
YQNRFLYLHDNIYYFGNDSKAATGWATIDGNRYYFEPNTAMGANGYKTID  2600
YQNRFLYLHDNIYYFGNDSKAATGWATIDGNRYYFEPNTAMGANGYKTID  2600
******************:*******.***********************

NKNFYFRNGLPQIGVFKGSNGFEYFAPANTDANNIEGQAIRYQNRFLHLL  2650
NKNFYFRNGLPQIGVFKGSNGFEYFAPANTDANNIEGQAIRYQNRFLHLL  2650
NKNFYFRNGLPQIGVFKGSNGFEYFAPANTDANNIEGQAIRYQNRFLHLL  2650
NKNFYFRNGLPQIGVFKGPNGFEYFAPANTDANNIDGQAIRYQNRFLHLL  2650
NKNFYFRNGLPQIGVFKGPNGFEYFAPANTDANNIDGQAIRYQNRFLHLL  2650
******************.***************:***************

GKIYYFGNNSKAVTGWQTINGKVYYFMPDTAMAAAGGLFEIDGVIYFFGV  2700
GKIYYFGNNSKAVTGWQTINGKVYYFMPDTAMAAAGGLFEIDGVIYFFGV  2700
GKIYYFGNNSKAVTGWQTINGKVYYFMPDTAMAAAGGLFEIDGVIYFFGV  2700
GKIYYFGNNSKAVTGWQTINSKVYYFMPDTAMAAAGGLFEIDGVIYFFGV  2700
GKIYYFGNNSKAVTGWQTINSKVYYFMPDTAMAAAGGLFEIDGVIYFFGV  2700
********************.*****************************

DGVKAPGIYG  2710  (SEQ ID NO: 1, 630)
DGVKAPGIYG  2710  (SEQ ID NO: 4)
DGVKAPGIYG  2710  (SEQ ID NO: 19, VPI10463)
DGVKAPGIYG  2710  (SEQ ID NO: 15, R20291)
DGVKAPGIYG  2710  (SEQ ID NO: 17, CD196)
**********
```

Fig. 2A

```
MSLVNRKQLEKMANVRFRTQEDEYVAILDALEEYHNMSENTVVEKYLKLKDINSLTDIYI  60
MSLVNRKQLEKMANVRFRTQEDEYVAILDALEEYHNMSENTVVEKYLKLKDINSLTDIYI  60
MSLVNRKQLEKMANVRFRTQEDEYVAILDALEEYHNMSENTVVEKYLKLKDINSLTDIYI  60
MSLVNRKQLEKMANVRFRVQEDEYVAILDALEEYHNMSENTVVEKYLKLKDINSLTDIYI  60
MSLVNRKQLEKMANVRFRVQEDEYVAILDALEEYHNMSENTVVEKYLKLKDINSLTDIYI  60
****************** *****************************************

DTYKKSGRNKALKKFKEYLVTEVLELKNNNLTPVEKNLHFVWIGGQINDTAINYINQWKD 120
DTYKKSGRNKALKKFKEYLVTEVLELKNNNLTPVEKNLHFVWIGGQINDTAINYINQWKD 120
DTYKKSGRNKALKKFKEYLVTEVLELKNNNLTPVEKNLHFVWIGGQINDTAINYINQWKD 120
DTYKKSGRNKALKKFKEYLVTEVLELKNNNLTPVEKNLHFVWIGGQINDTAINYINQWKD 120
DTYKKSGRNKALKKFKEYLVTEVLELKNNNLTPVEKNLHFVWIGGQINDTAINYINQWKD 120
************************************************************

VNSDYNVNVFYDSNAFLINTLKKTVVESAINDTLESFRENLNDPRFDYNKFFRKRMEIIY 180
VNSDYNVNVFYDSNAFLINTLKKTVVESAINDTLESFRENLNDPRFDYNKFFRKRMEIIY 180
VNSDYNVNVFYDSNAFLINTLKKTVVESAINDTLESFRENLNDPRFDYNKFFRKRMEIIY 180
VNSDYNVNVFYDSNAFLINTLKKTIVESATNDTLESFRENLNDPRFDYNKFYRKRMEIIY 180
VNSDYNVNVFYDSNAFLINTLKKTIVESATNDTLESFRENLNDPRFDYNKFYRKRMEIIY 180
************************ ***** ****************** **********

DKQKNFINYYKAQREENPELIIDDIVKTYLSNEYSKEIDELNTYIEESLNKITQNSGNDV 240
DKQKNFINYYKAQREENPELIIDDIVKTYLSNEYSKEIDELNTYIEESLNKITQNSGNDV 240
DKQKNFINYYKAQREENPELIIDDIVKTYLSNEYSKEIDELNTYIEESLNKITQNSGNDV 240
DKQKNFINYYKTQREENPDLIIDDIVKIYLSNEYSKDIDELNSYIEESLNKVTENSGNDV 240
DKQKNFINYYKTQREENPDLIIDDIVKIYLSNEYSKDIDELNSYIEESLNKVTENSGNDV 240
*********** ****** ******** ******* ***** ******** * ******

RNFEEFKNGESPNLYEQELVERWNLAAASDILRISALKEIGGMYLDVDMLPGIQPDLFES 300
RNFEEFKNGESPNLYEQELVERWNLAAASDILRISALKEIGGMYLDVDMLPGIQPDLFES 300
RNFEEFKNGESPNLYEQELVERWNLAAASDILRISALKEIGGMYLAVAMLPGIQPDLFES 300
RNFEEFKGGESPKLYEQELVERWNLAAASDILRISALKEVGGVYLDVDMLPGIQPDLFES 300
RNFEEFKGGESPKLYEQELVERWNLAAASDILRISALKEVGGVYLDVDMLPGIQPDLFES 300
******* **** ************************* ** **  * ************

IEKPSSVTVDFWEMTKLEAIMKYKEYIPEYTSEHFDMLDEEVQSSFESVLASKSDKSEIF 360
IEKPSSVTVDFWEMTKLEAIMKYKEYIPEYTSEHFDMLDEEVQSSFESVLASKSDKSEIF 360
IEKPSSVTVDFWEMTKLEAIMKYKEYIPEYTSEHFDMLDEEVQSSFESVLASKSDKSEIF 360
IEKPSSVTVDFWEMVKLEAIMKYKEYIPGYTSEHFDMLDEEVQSSFESVLASKSDKSEIF 360
IEKPSSVTVDFWEMVKLEAIMKYKEYIPGYTSEHFDMLDEEVQSSFESVLASKSDKSEIF 360
************** ************* *******************************

SSLGDMEASPLEVKIAFNSKGIINQGLISVKDSYCSNLIVKQIENRYKILNNSLNPAISE 420
SSLGDMEASPLEVKIAFNSKGIINQGLISVKDSYCSNLIVKQIENRYKILNNSLNPAISE 420
SSLGDMEASPLEVKIAFNSKGIINQGLISVKDSYCSNLIVKQIENRYKILNNSLNPAISE 420
SSLGDMEASPLEVKIAFNSKGIINQGLISVKDSYCSNLIVKQIENRYKILNNSLNPAISE 420
SSLGDMEASPLEVKIAFNSKGIINQGLISVKDSYCSNLIVKQIENRYKILNNSLNPAISE 420
************************************************************

DNDFNTTTNTFIDSIMAEANADNGRFMMELGKYLRVGFFPDVKTTINLSGPEAYAAAYQD 480
DNDFNTTTNTFIDSIMAEANADNGRFMMELGKYLRVGFFPDVKTTINLSGPEAYAAAYQD 480
DNDFNTTTNTFIDSIMAEANADNGRFMMELGKYLRVGFFPDVKTTINLSGPEAYAAAYQD 480
```

FIG. 2B

```
DNDFNTTTNAFIDSIMAEANADNGRFNNELGKYLRVGFFPDVKTTINLSGPEAYAAAYQD 480
DNDFNTTTNAFIDSIMAEANADNGRFNNELGKYLRVGFFPDVKTTINLSGPEAYAAAYQD 480
*********:**************************************************

LLMFKEGSMNIHLIEADLRNFEISKTNISQSTEQEMASLWSFDDARAKAQFEEYKRNYFE 540
LLMFKEGSMNIHLIEADLRNFEISKTNISQSTEQEMASLWSFDDARAKAQFEEYKRNYFE 540
LLMFKEGSMNIHLIEADLRNFEISKTNISQSTEQEMASLWSFDDARAKAQFEEYKRNYFE 540
LLMFKEGSMNIHLIEADLRNFEISKTNISQSTEQEMASLWSFDDARAKAQFEEYKKNYFE 540
LLMFKEGSMNIHLIEADLRNFEISKTNISQSTEQEMASLWSFDDARAKAQFEEYKKNYFE 540
**********************************************:****

GSLGEDDNLDFSQNIVVDKEYLLEKISSLARSSERGYIHYIVQLQGDKISYEAACNLFAK 600
GSLGEDDNLDFSQNIVVDKEYLLEKISSLARSSERGYIHYIVQLQGDKISYEAACNLFAK 600
GSLGEDDNLDFSQNIVVDKEYLLEKISSLARSSERGYIHYIVQLQGDKISYEAACNLFAK 600
GSLGEDDNLDFSQNTVVDKEYLLEKISSLARSSERGYIHYIVQLQGDKISYEAACNLFAK 600
GSLGEDDNLDFSQNTVVDKEYLLEKISSLARSSERGYIHYIVQLQGDKISYEAACNLFAK 600
************** *********************************************

TPYDSVLFQKNIEDSEIAYYYNPGDGEIQEIDKYKIPSIISDRPKIKLTFIGHGKDEFNT 660
TPYDSVLFQKNIEDSEIAYYYNPGDGEIQEIDKYKIPSIISDRPKIKLTFIGHGKDEFNT 660
TPYDSVLFQKNIEDSEIAYYYNPGDGEIQEIDKYKIPSIISDRPKIKLTFIGHGKDEFNT 660
TPYDSVLFQKNIEDSEIAYYYNPGDGEIQEIDKYKIPSIISDRPKIKLTFIGHGKDEFNT 660
TPYDSVLFQKNIEDSEIAYYYNPGDGEIQEIDKYKIPSIISDRPKIKLTFIGHGKDEFNT 660
************************************************************

DIFAGFDVDSLSTEIEAAIDLAKEDISPKSIEINLLGCNMFSYSINVEETYPGKLLLKVK 720
DIFAGFDVDSLSTEIEAAIDLAKEDISPKSIEINLLGCNMFSYSINVEETYPGKLLLKVK 720
DIFAGFDVDSLSTEIEAAIDLAKEDISPKSIEINLLGANMFSYSINVEETYPGKLLLKVK 720
DIFAGLDVDSLSTEIETAIDLAKEDISPKSIEINLLGCNMFSYSVNVEETYPGKLLLRVK 720
DIFAGLDVDSLSTEIETAIDLAKEDISPKSIEINLLGCNMFSYSVNVEETYPGKLLLRVK 720
*****:**********:********************,*****:***********:**

DKISELMPSISQDSIIVSANQYEVRINSEGRRELLDHSGEWINKEESIIKDISSKEYISF 780
DKISELMPSISQDSIIVSANQYEVRINSEGRRELLDHSGEWINKEESIIKDISSKEYISF 780
DKISELMPSISQDSIIVSANQYEVRINSEGRRELLDHSGEWINKEESIIKDISSKEYISF 780
DKVSELMPSISQDSIIVSANQYEVRINSEGRRELLDHSGEWINKEESIIKDISSKEYISF 780
DKVSELMPSISQDSIIVSANQYEVRINSEGRRELLDHSGEWINKEESIIKDISSKEYISF 780
**:*********************************************************

NPKENKITVKSKNLPELSTLLQEIRNNSNSSDIELEEKVMLTECEINVISNIDTQIVEER 840
NPKENKITVKSKNLPELSTLLQEIRNNSNSSDIELEEKVMLTECEINVISNIDTQIVEER 840
NPKENKITVKSKNLPELSTLLQEIRNNSNSSDIELEEKVMLTECEINVISNIDTQIVEER 840
NPKENKIIVKSKNLPELSTLLQEIRNNSNSSDIELEEKVMLAECEINVISNIDTQVVEGR 840
NPKENKIIVKSKNLPELSTLLQEIRNNSNSSDIELEEKVMLAECEINVISNIDTQVVEGR 840
******* ********************************:*************:** *

IEEAKNLTSDSINYIKDEFKLIESISDALCDLKQQNELEDSHFISFEDISETDEGFSIRF 900
IEEAKNLTSDSINYIKDEFKLIESISDALCDLKQQNELEDSHFISFEDISETDEGFSIRF 900
IEEAKNLTSDSINYIKDEFKLIESISDALCDLKQQNELEDSHFISFEDISETDEGFSIRF 900
IEEAKSLTSDSINYIKNEFKLIESISDALYDLKQQNELEESHFISFEDILETDEGFSIRF 900
IEEAKSLTSDSINYIKNEFKLIESISDALYDLKQQNELEESHFISFEDILETDEGFSIRF 900
*****,**********:***********  *********,************ ********
```

FIG. 2C

```
INKETGESIFVETEKTIFSEYANHITEEISKIKGTIFDTVNGKLVKKVNLDTTHEVNTLN 960
INKETGESIFVETEKTIFSEYANHITEEISKIKGTIFDTVNGKLVKKVNLDTTHEVNTLN 960
INKETGESIFVETEKTIFSEYANHITEEISKIKGTIFDTVNGKLVKKVNLDTTHEVNTLN 960
IDKETGESIFVETEKAIFSEYANHITEEISKIKGTIFDTVNGKLVKKVNLDATHEVNTLN 960
IDKETGESIFVETEKAIFSEYANHITEEISKIKGTIFDTVNGKLVKKVNLDATHEVNTLN 960
*:**************:******************************:*******

AAFFIQSLIEYNSSKESLSNLSVAMKVQVYAQLFSTGLNTITDAAKVVELVSTALDETID 1020
AAFFIQSLIEYNSSKESLSNLSVAMKVQVYAQLFSTGLNTITDAAKVVELVSTALDETID 1020
AAFFIQSLIEYNSSKESLSNLSVAMKVQVYAQLFSTGLNTITDAAKVVELVSTALDETID 1020
AAFFIQSLIEYNSSKESLSNLSVAMKVQVYAQLFSTGLNTITDAAKVVELVSTALDETID 1020
AAFFIQSLIEYNSSKESLSNLSVAMKVQVYAQLFSTGLNTITDAAKVVELVSTALDETID 1020
************************************************************

LLPTLSEGLPIIATIIDGVSLGAAIKELSETSDPLLRQEIEAKIGIMAVNLTTATTAIIT 1080
LLPTLSEGLPIIATIIDGVSLGAAIKELSETSDPLLRQEIEAKIGIMAVNLTTATTAIIT 1080
LLPTLSEGLPIIATIIDGVSLGAAIKELSETSDPLLRQEIEAKIGIMAVNLTTATTAIIT 1080
LLPTLSEGLPVIATIIDGVSLGAAIKELSETSDPLLRQEIEAKIGIMAVNLTAATTAIIT 1080
LLPTLSEGLPVIATIIDGVSLGAAIKELSETSDPLLRQEIEAKIGIMAVNLTAATTAIIT 1080
**********:*************************************** :*******

SSLGIASGFSILLVPLAGISAGIPSLVNNELVLRDKATKVVDYFKHVSLVETEGVFTLLD 1140
SSLGIASGFSILLVPLAGISAGIPSLVNNELVLRDKATKVVDYFKHVSLVETEGVFTLLD 1140
SSLGIASGFSILLVPLAGISAGIPSLVNNELVLRDKATKVVDYFKHVSLVETEGVFTLLD 1140
SSLGIASGFSILLVPLAGISAGIPSLVNNELILRDKATKVVDYFSHISLAESEGAFTSLD 1140
SSLGIASGFSILLVPLAGISAGIPSLVNNELILRDKATKVVDYFSHISLAESEGAFTSLD 1140
*******************************:************.::**.:**.** **

DKIMMPQDDLVISEIDFNNNSIVLGKCEIWRMEGGSGHTVTDDIDHFFSAPSITYREPHL 1200
DKIMMPQDDLVISEIDFNNNSIVLGKCEIWRMEGGSGHTVTDDIDHFFSAPSITYREPHL 1200
DKIMMPQDDLVISEIDFNNNSIVLGKCEIWRMEGGSGHTVTDDIDHFFSAPSITYREPHL 1200
DKIMMPQDDLVISEIDFNNNSITLGKCEIWRMEGGSGHTVTDDIDHFFSAPSITYREPHL 1200
DKIMMPQDDLVISEIDFNNNSITLGKCEIWRMEGGSGHTVTDDIDHFFSAPSITYREPHL 1200
*********************:**************************************

SIYDVLEVQKEELDLSKDLMVLPNAPNRVFAWETGWTPGLRSLENDGTKLLDRIRDNYEG 1260
SIYDVLEVQKEELDLSKDLMVLPNAPNRVFAWETGWTPGLRSLENDGTKLLDRIRDNYEG 1260
SIYDVLEVQKEELDLSKDLMVLPNAPNRVFAWETGWTPGLRSLENDGTKLLDRIRDNYEG 1260
SIYDVLEVQKEELDLSKDLMVLPNAPNRVFAWETGWTPGLRSLENDGTKLLDRIRDNYEG 1260
SIYDVLEVQKEELDLSKDLMVLPNAPNRVFAWETGWTPGLRSLENDGTKLLDRIRDNYEG 1260
************************************************************

EFYWRYFAFIADALITTLKPRYEDTNIRINLDSNTRSFIVPIITTEYIREKLSYSFYGSG 1320
EFYWRYFAFIADALITTLKPRYEDTNIRINLDSNTRSFIVPIITTEYIREKLSYSFYGSG 1320
EFYWRYFAFIADALITTLKPRYEDTNIRINLDSNTRSFIVPIITTEYIREKLSYSFYGSG 1320
EFYWRYFAFIADALITTLKPRYEDTNIRINLDSNTRSFIVPVITTEYIREKLSYSFYGSG 1320
EFYWRYFAFIADALITTLKPRYEDTNIRINLDSNTRSFIVPVITTEYIREKLSYSFYGSG 1320
****************************************:*******************

GTYALSLSQYNMGINIELSESDVWIIDVDNVVRDVTIESDKIKKGDLIEGILSTLSIEEN 1380
GTYALSLSQYNMGINIELSESDVWIIDVDNVVRDVTIESDKIKKGDLIEGILSTLSIEEN 1380
GTYALSLSQYNMGINIELSESDVWIIDVDNVVRDVTIESDKIKKGDLIEGILSTLSIEEN 1380
```

FIG. 2D

```
GTYALSLSQYNMNINIELNENDTWVIDVDNVVRDVTIESDKIKKGDLIENILSKLSIEDN  1380
GTYALSLSQYNMNINIELNENDTWVIDVDNVVRDVTIESDKIKKGDLIENILSKLSIEDN  1380
**********.*****.*.*;************************.***.****;*

KIILNSHEINFSGEVNGSNGFVSLTFSILEGINAIIEVDLLSKSYKLLISGELKILMLNS  1440
KIILNSHEINFSGEVNGSNGFVSLTFSILEGINAIIEVDLLSKSYKLLISGELKILMLNS  1440
KIILNSHEINFSGEVNGSNGFVSLTFSILEGINAIIEVDLLSKSYKLLISGELKILMLNS  1440
KIILDNHEINFSGTLNGGNGFVSLTFSILEGINAVIEVDLLSKSYKVLISGELKTLMANS  1440
KIILDNHEINFSGTLNGGNGFVSLTFSILEGINAVIEVDLLSKSYKVLISGELKTLMANS  1440
****;.*******..;**.*************************;**********  **.**

NHIQQKIDYIGFNSELQKNIPYSFVDSEGKENGFINGSTKEGLFVSELPDVVLISKVYMD  1500
NHIQQKIDYIGFNSELQKNIPYSFVDSEGKENGFINGSTKEGLFVSELPDVVLISKVYMD  1500
NHIQQKIDYIGFNSELQKNIPYSFVDSEGKENGFINGSTKEGLFVSELPDVVLISKVYMD  1500
NSVQQKIDYIGLNSELQKNIPYSFMDDKGKENGFINCSTKEGLFVSELSDVVLISKVYMD  1500
NSVQQKIDYIGLNSELQKNIPYSFMDDKGKENGFINCSTKEGLFVSELSDVVLISKVYMD  1500
* ;********;************;*.;******** ***********.***********

DSKPSFGYYSNNLKDVKVITKDNVNILTGYYLKDDIKISLSLTLQDEKTIKLNSVHLDES  1560
DSKPSFGYYSNNLKDVKVITKDNVNILTGYYLKDDIKISLSLTLQDEKTIKLNSVHLDES  1560
DSKPSFGYYSNNLKDVKVITKDNVNILTGYYLKDDIKISLSLTLQDEKTIKLNSVHLDES  1560
NSKPLFGYCSNDLKDVKVITKDDVIILTGYYLKDDIKISLSFTIQDENTIKLNGVYLDEN  1560
NSKPLFGYCSNDLKDVKVITKDDVIILTGYYLKDDIKISLSFTIQDENTIKLNGVYLDEN  1560
;*** *** **;*********;* ********************;*;***;****.*;***.

GVAEILKFMNRKGNTNTSDSLMSFLESMNIKSIPVNFLQSNIKFILDANFIISGTTSIGQ  1620
GVAEILKFMNRKGNTNTSDSLMSFLESMNIKSIPVNFLQSNIKFILDANFIISGTTSIGQ  1620
GVAEILKFMNRKGNTNTSDSLMSFLESMNIKSIPVNFLQSNIKFILDANFIISGTTSIGQ  1620
GVAEILKFMNKKGSTNTSDSLMSFLESMNIKSIFINSLQSNTKLILDTNFIISGTTSIGQ  1620
GVAEILKFMNKKGSTNTSDSLMSFLESMNIKSIFINSLQSNTKLILDTNFIISGTTSIGQ  1620
**********;**.********************;* **** *;***;***********

FEPICDENDNIQPYFIKFNTLETNYTLYVGNRQNMIVEPNYDLDDSGDISSTVINFSQKY  1680
FEPICDENDNIQPYFIKFNTLETNYTLYVGNRQNMIVEPNYDLDDSGDISSTVINFSQKY  1680
FEPICDENDNIQPYFIKFNTLETNYTLYVGNRQNMIVEPNYDLDDSGDISSTVINFSQKY  1680
FEPICDKDNNIQPYFIKFNTLETKYTLYVGNRQNMIVEPNYDLDDSGDISSTVINFSQKY  1680
FEPICDKDNNIQPYFIKFNTLETKYTLYVGNRQNMIVEPNYDLDDSGDISSTVINFSQKY  1680
******;;;************;*****************************

LYGIDSCVNKVVISPNIYTDEINITPVYETNNTYPEVIVLDANYINEKINVNINDLSIRY  1740
LYGIDSCVNKVVISPNIYTDEINITPVYETNNTYPEVIVLDANYINEKINVNINDLSIRY  1740
LYGIDSCVNKVVISPNIYTDEINITPVYETNNTYPEVIVLDANYINEKINVNINDLSIRY  1740
LYGIDSCVNKVIISPNIYTDEINITPIYEANNTYPEVIVLDTNYISEKINININDLSIRY  1740
LYGIDSCVNKVIISPNIYTDEINITPIYEANNTYPEVIVLDTNYISEKINININDLSIRY  1740
***********;**************;**.*********;***.****;*********

VWSNDGNDFILMSTSEENKVSQVKIRFVNVFKDKTLANKLSFNFSDKQDVPVSEIILSFT  1800
VWSNDGNDFILMSTSEENKVSQVKIRFVNVFKDKTLANKLSFNFSDKQDVPVSEIILSFT  1800
VWSNDGNDFILMSTSEENKVSQVKIRFVNVFKDKTLANKLSFNFSDKQDVPVSEIILSFT  1800
VWSNDGSDFILMSTDEENKVSQVKIRFTNVFKGNTISDKISFNFSDKQDVSINKVISTFT  1800
VWSNDGSDFILMSTDEENKVSQVKIRFTNVFKGNTISDKISFNFSDKQDVSINKVISTFT  1800
******.*******.*******.****,*;**::*;*********.;..::*.;**
```

FIG. 2E

```
PSYYEDGLIGYDLGLVSLYNEKFYINNFGMMVSGLIYINDSLYYFKPPVNNLITGFVTVG 1860
PSYYEDGLIGYDLGLVSLYNEKFYINNFGMMVSGLIYINDSLYYFKPPVNNLITGFVTVG 1860
PSYYEDGLIGYDLGLVSLYNEKFYINNFGMMVSGLIYINDSLYYFKPPVNNLITGFVTVG 1860
PSYYVEGLLNYDLGLISLYNEKFYINNFGMMVSGLVYINDSLYYFKPPIKNLITGFTTIG 1860
PSYYVEGLLNYDLGLISLYNEKFYINNFGMMVSGLVYINDSLYYFKPPIKNLITGFTTIG 1860
****  ;**;.************************;************;;******.*;*

DDKYYFNPINGGAASIGETIIDDKNYYFNQSGVLQTGVFSTEDGFKYFAPANTLDENLEG 1920
DDKYYFNPINGGAASIGETIIDDKNYYFNQSGVLQTGVFSTEDGFKYFAPANTLDENLEG 1920
DDKYYFNPINGGAASIGETIIDDKNYYFNQSGVLQTGVFSTEDGFKYFAPANTLDENLEG 1920
DDKYYFNPDNGGAASVGETIIDGKNYYFSQNGVLQTGVFSTEDGFKYFAPADTLDENLEG 1920
DDKYYFNPDNGGAASVGETIIDGKNYYFSQNGVLQTGVFSTEDGFKYFAPADTLDENLEG 1920
********  ******;******.*****.*.***********************;*******

EAIDFTGKLIIDENIYYFDDNYRGAVEWKELDGEMHYFSPETGKAFKGLNQIGDYKYYFN 1980
EAIDFTGKLIIDENIYYFDDNYRGAVEWKELDGEMHYFSPETGKAFKGLNQIGDYKYYFN 1980
EAIDFTGKLIIDENIYYFDDNYRGAVEWKELDGEMHYFSPETGKAFKGLNQIGDYKYYFN 1980
EAIDFTGKLTIDENVYYFGDNYRAAIEWQTLDDEVYYFSTDTGRAFKGLNQIGDDKFYFN 1980
EAIDFTGKLTIDENVYYFGDNYRAAIEWQTLDDEVYYFSTDTGRAFKGLNQIGDDKFYFN 1980
********  ****;***.****.*;**;  **.*;;***.;**;************  *;***

SDGVMQKGFVSINDNKHYFDDSGVMKVGYTEIDGKHFYFAENGEMQIGVFNTEDGFKYFA 2040
SDGVMQKGFVSINDNKHYFDDSGVMKVGYTEIDGKHFYFAENGEMQIGVFNTEDGFKYFA 2040
SDGVMQKGFVSINDNKHYFDDSGVMKVGYTEIDGKHFYFAENGEMQIGVFNTEDGFKYFA 2040
SDGIMQKGFVNINDKTFYFDDSGVMKSGYTEIDGKYFYFAENGEMQIGVFNTADGFKYFA 2040
SDGIMQKGFVNINDKTFYFDDSGVMKSGYTEIDGKYFYFAENGEMQIGVFNTADGFKYFA 2040
***;******.***;..*********  *******;*************** *******

HHNEDLGNEEGEEISYSGILNFNNKIYYFDDSFTAVVGWKDLEDGSKYYFDEDTAEAYIG 2100
HHNEDLGNEEGEEISYSGILNFNNKIYYFDDSFTAVVGWKDLEDGSKYYFDEDTAEAYIG 2100
HHNEDLGNEEGEEISYSGILNFNNKIYYFDDSFTAVVGWKDLEDGSKYYFDEDTAEAYIG 2100
HHDEDLGNEEGEALSYSGILNFNNKIYYFDDSFTAVVGWKDLEDGSKYYFDEDTAEAYIG 2100
HHDEDLGNEEGEALSYSGILNFNNKIYYFDDSFTAVVGWKDLEDGSKYYFDEDTAEAYIG 2100
**;********  ;************************************

LSLINDGQYYFNDDGIMQVGFVTINDKVFYFSDSGIIESGVQNIDDNYFYIDDNGIVQIG 2160
LSLINDGQYYFNDDGIMQVGFVTINDKVFYFSDSGIIESGVQNIDDNYFYIDDNGIVQIG 2160
LSLINDGQYYFNDDGIMQVGFVTINDKVFYFSDSGIIESGVQNIDDNYFYIDDNGIVQIG 2160
ISIINDGKYYFNDSGIMQIGFVTINNEVFYFSDSGIVESGMQNIDDNYFYIDENGLVQIG 2160
ISIINDGKYYFNDSGIMQIGFVTINNEVFYFSDSGIVESGMQNIDDNYFYIDENGLVQIG 2160
;*;****;*****.****;****;******;;********;***;***********;**;****

VFDTSDGYKYFAPANTVNDNIYGQAVEYSGLVRVGEDVYYFGETYTIETGWIYDMENESD 2220
VFDTSDGYKYFAPANTVNDNIYGQAVEYSGLVRVGEDVYYFGETYTIETGWIYDMENESD 2220
VFDTSDGYKYFAPANTVNDNIYGQAVEYSGLVRVGEDVYYFGETYTIETGWIYDMENESD 2220
VFDTSDGYKYFAPANTVNDNIYGQAVEYSGLVRVGEDVYYFGETYTIETGWIYDMENESD 2220
VFDTSDGYKYFAPANTVNDNIYGQAVEYSGLVRVGEDVYYFGETYTIETGWIYDMENESD 2220
************************************************************
```

Fig 2F

```
KYYFNPETKKACKGINLIDDIKYYFDEKGIMRTGLISFENNNYYFNENGEMQFGYINIED 2280
KYYFNPETKKACKGINLIDDIKYYFDEKGIMRTGLISFENNNYYFNENGEMQFGYINIED 2280
KYYFNPETKKACKGINLIDDIKYYFDEKGIMRTGLISFENNNYYFNENGEMQFGYINIED 2280
KYYFDPETKKAYKGINVIDDIKYYFDENGIMRTGLITFEDNNYYFNEDGIMQYGYLNIED 2280
KYYFDPETKKAYKGINVIDDIKYYFDENGIMRTGLITFEDNNYYFNEDGIMQYGYLNIED 2280
****,******  ****,*************,********,**,*,*****,*  **,**,****

KMFYFGEDGVMQIGVFNTPDGFKYFAHQNTLDENFEGESINYTGWLDLDEKRYYFTDEYI 2340
KMFYFGEDGVMQIGVFNTPDGFKYFAHQNTLDENFEGESINYTGWLDLDEKRYYFTDEYI 2340
KMFYFGEDGVMQIGVFNTPDGFKYFAHQNTLDENFEGESINYTGWLDLDEKRYYFTDEYI 2340
KTFYFSEDGIMQIGVFNTPDGFKYFAHQNTLDENFEGESINYTGWLDLDEKRYYFTDEYI 2340
KTFYFSEDGIMQIGVFNTPDGFKYFAHQNTLDENFEGESINYTGWLDLDEKRYYFTDEYI 2340
*  ***,***,****************************************************

AATGSVIIDGEEYYFDPDTAQLVISE 2366 (SEQ ID NO: 2, 630)
AATGSVIIDGEEYYFDPDTAQLVISE 2366 (SEQ ID NO: 25, VPI10463)
AATGSVIIDGEEYYFDPDTAQLVISE 2366 (SEQ ID NO: 6)
AATGSVIIDGEEYYFDPDTAQLVISE 2366 (SEQ ID NO: 21, R20291)
AATGSVIIDGEEYYFDPDTAQLVISE 2366 (SEQ ID NO: 23, CD196)
*************************
```

FIG. 4A

| | No Toxin | Toxin B | | | DM | TM |
|---|---|---|---|---|---|---|
| µg | | 10 | 1 | 0.1 | .01 | 10 | 10 |

FIG. 4B

Tcd A    Tcd B

C   wt   wt+TM   TM   wt   wt+TM   TM

← 28 kDa RhoA GTPase 0   1   1   0   1   1   0 [Toxin- ng]
0   0   100   100   0   100   100 [Toxin mutant -µg]

FIG. 6

| | Triple Mutant | Hepta Mutant |
|---|---|---|
| $EC_{50}$ | 0.02078 | 0.03590 |

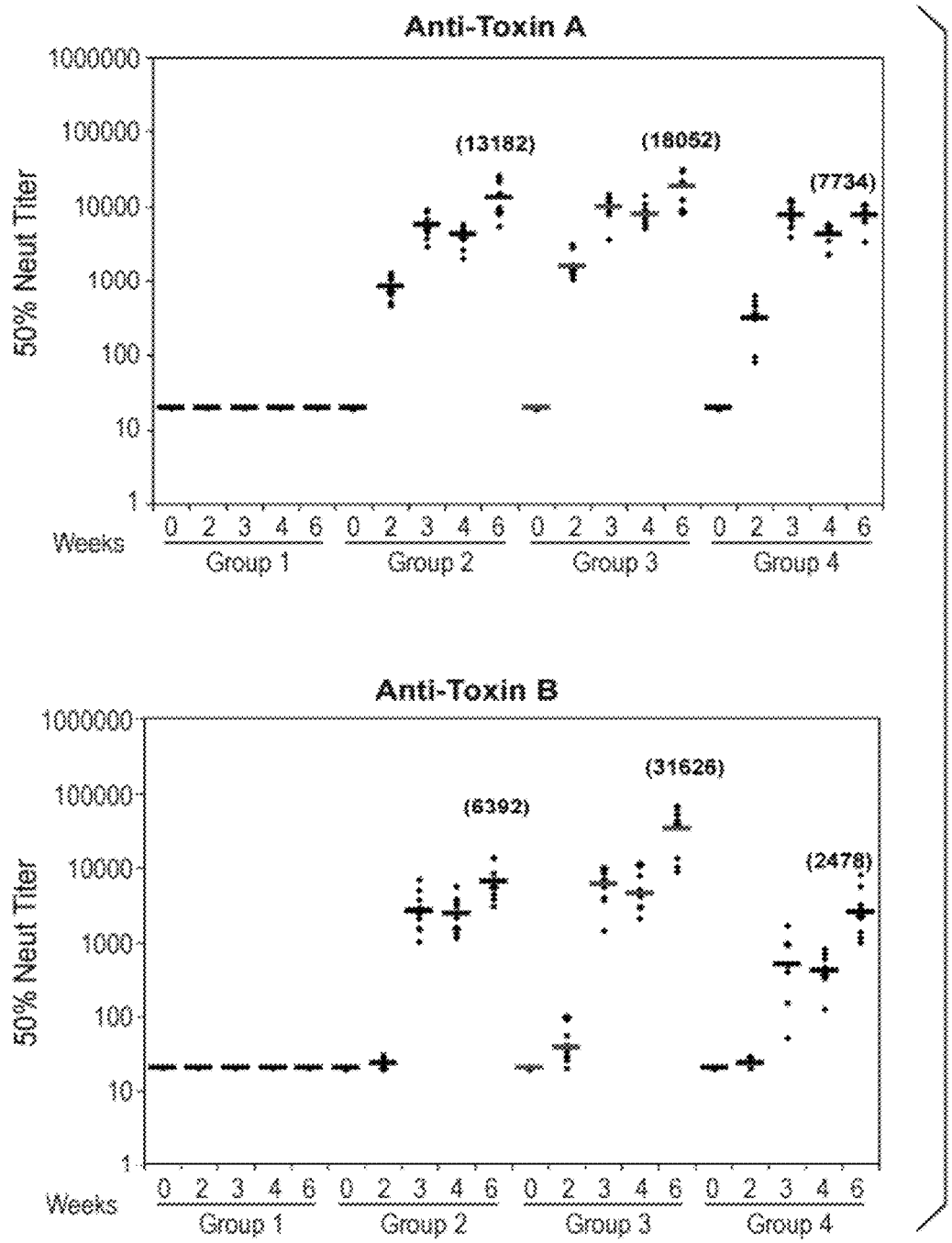

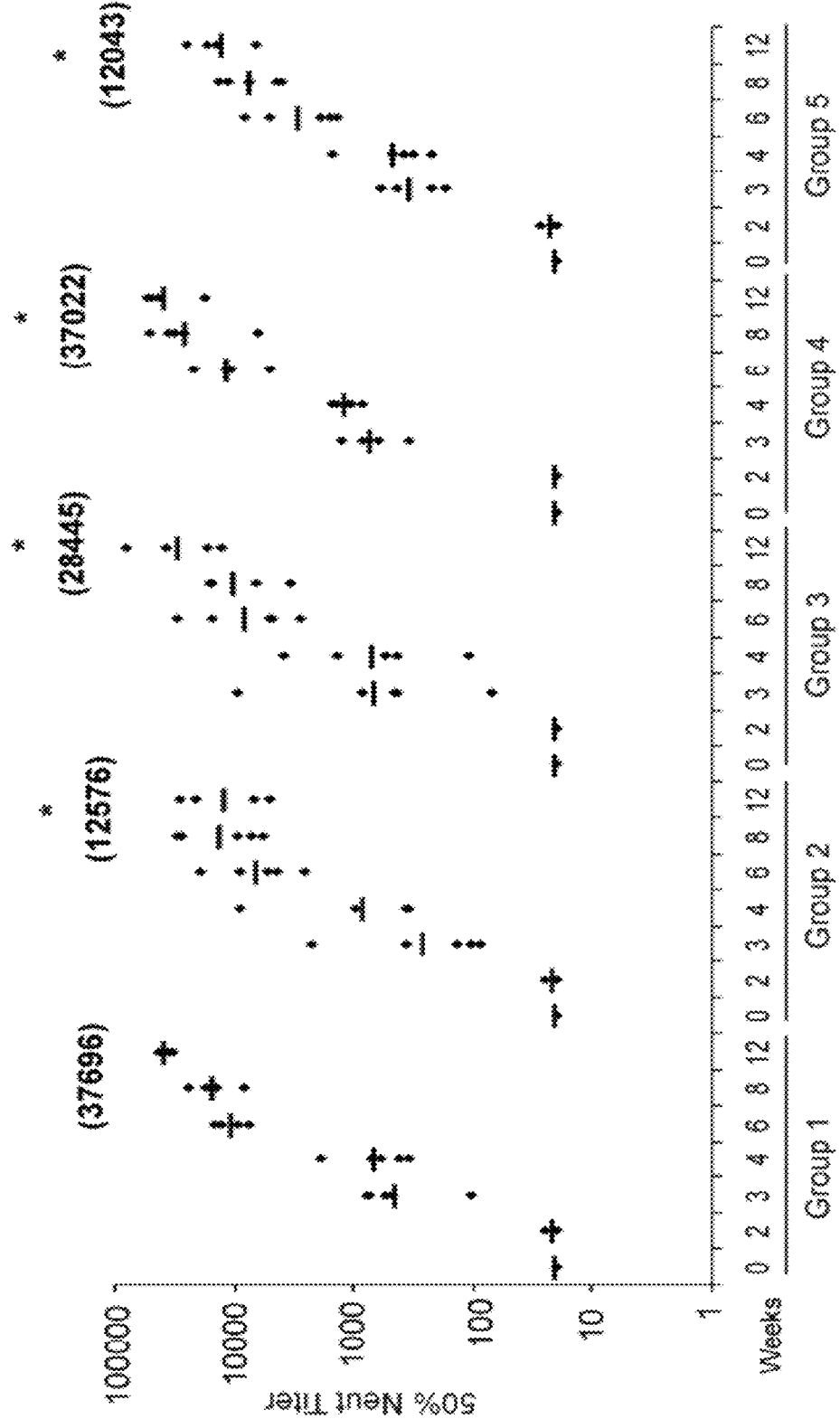

FIG. 17

Variable Light Chain (muK)
MKLPVRLLVLMFWIPGSSSDVVMTHTPLSLPVSLGDQASMSC*RS*
*SQSLIHSNGNTYLH*WYLQKPGQSPKLLIS*KVSNRFS*GVPDRFSG
SGSGTDFTLKISRVEAEDLGVYFC*SQTTYFPYT*FGGGTREIK**RAD
AAPTVSIFPPSS** (SEQ ID NO: 36)

Variable Heavy Chain (mIgE)
MYLGLNCVFIVFLLKGVQSEVNLEESGGGLVQPGGSMKLSCVAS
*GFTFTNYWMN*WVRQSPEKGLEWIA*EIRLKSHNYATHFAE*SVKG
RFTISRDDSKSAVSLQMTNLTPEDTGIFYCTW*DYYGNPAFVY*WG
QGTLVTVSA**ASIRNPQLYPLKPCKGTASMTLGCLVKDYFPGPVT
VTWYSDSLNMSTVN** (SEQ ID NO: 37)

FIG. 20B

Toxin A Neutralization by mAb A3-25 plus A65-33 Dilutions

- ● Rab Anti-A dilutions (+ control)
- ■ A3-25 alone
- △ 1:100
- ▷ 1:200
- ◇ 1:400
- ○ 1:800
- □ 1:1600
- ◀ 1:3200
- ▶ 1:6400
- ◆ 1:12800
- ✶ Toxin A only (4×EC$_{50}$)
- ∗ Cell only

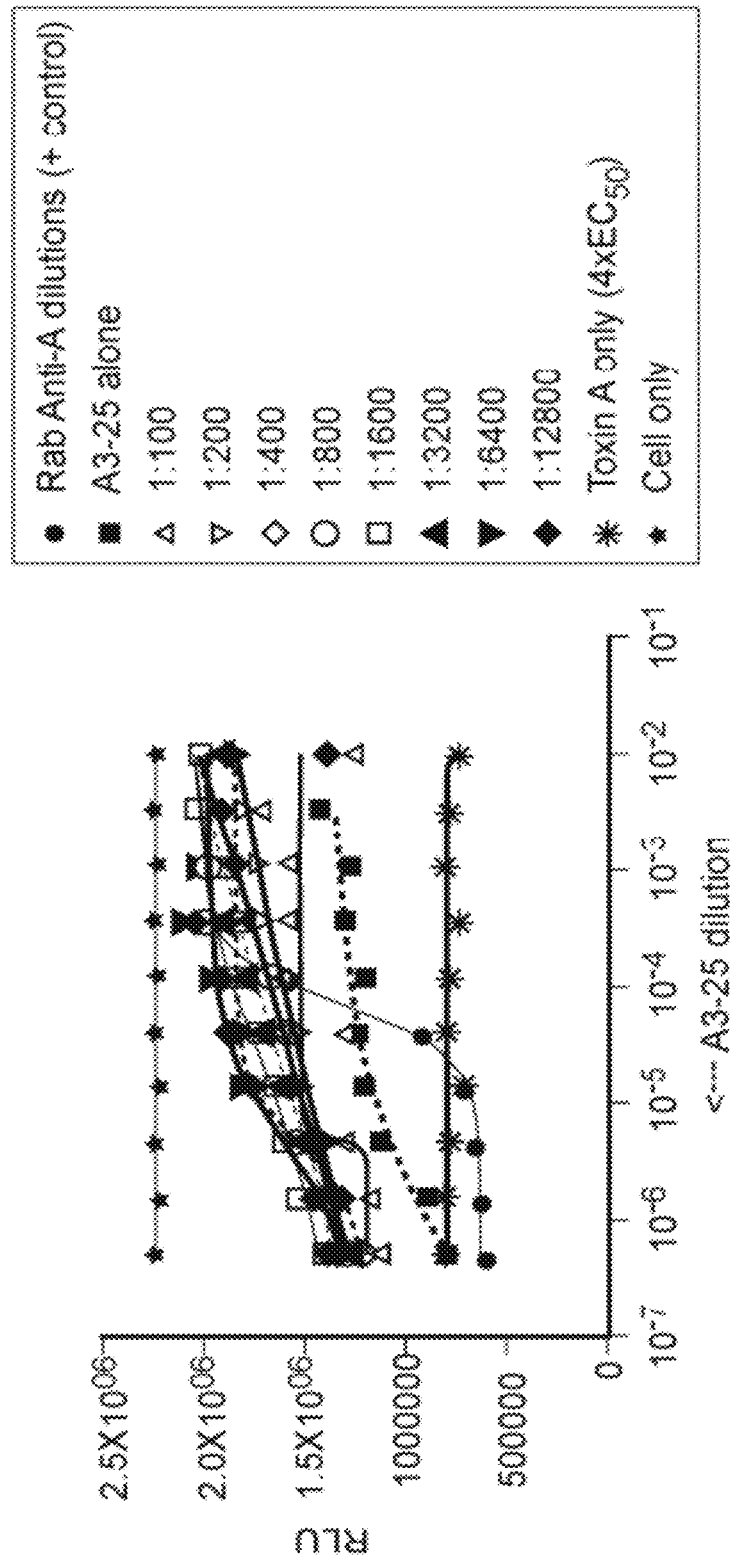

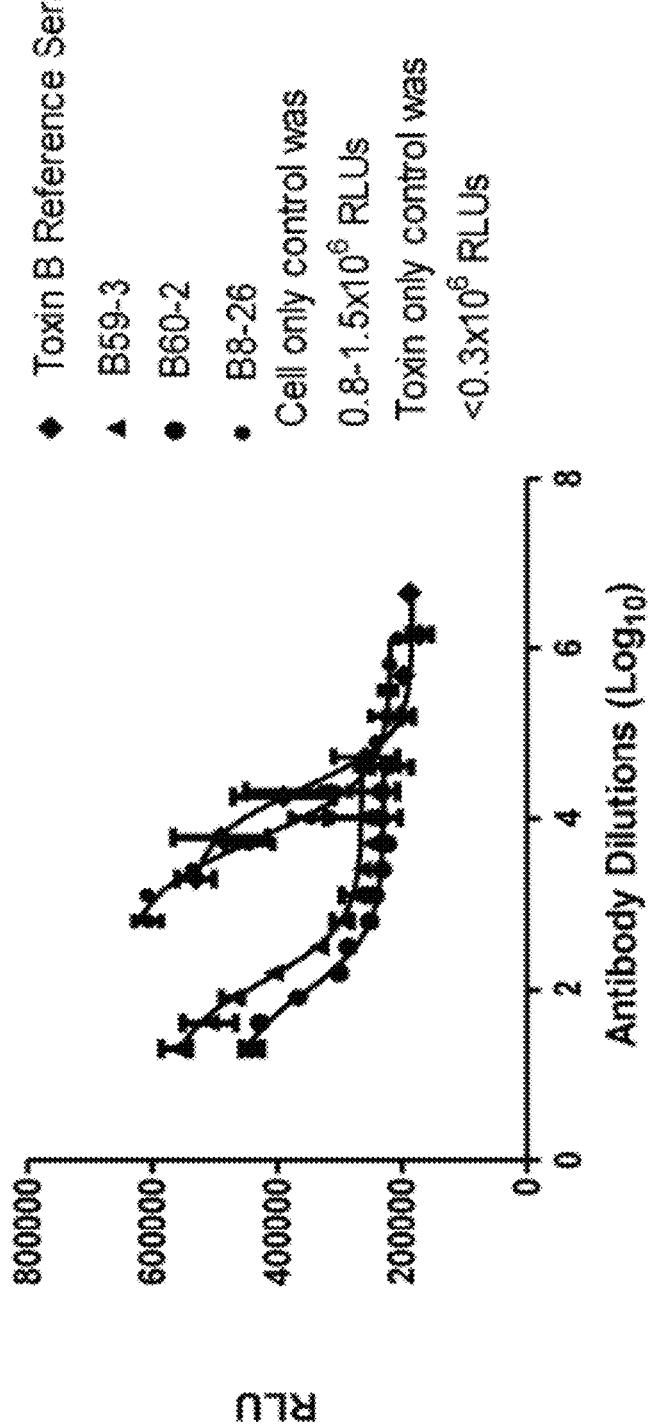

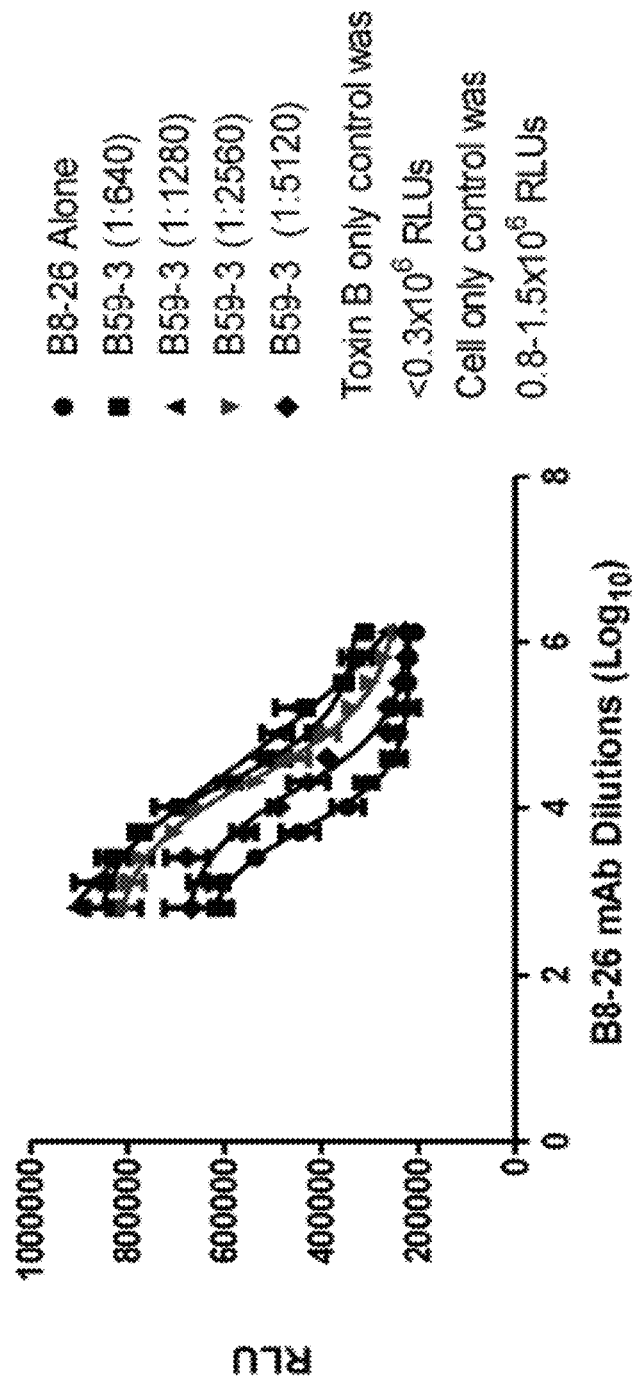

2007838 /NAP7/126

2007886/NAP1

2009292 /NAP1

2004013/NAP1/27

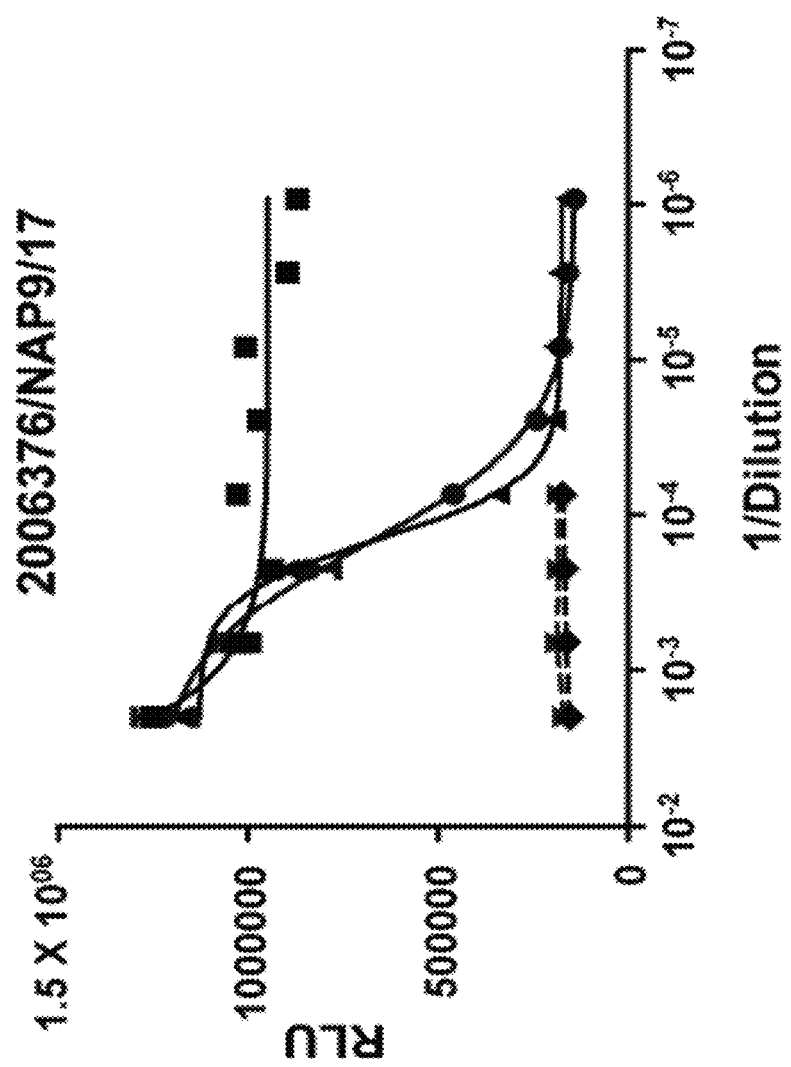

US 8,481,692 B2

COMPOSITIONS RELATING TO A MUTANT *CLOSTRIDIUM DIFFICILE* TOXIN AND METHODS THEREOF

CROSS-REFERENCE TO RELATED APPLICATIONS

The present application claims the benefit of U.S. Provisional Patent Application 61/478,474, filed on Apr. 22, 2011, and U.S. Provisional Patent Application 61/478,899, filed Apr. 25, 2011. The entire contents of the aforementioned applications are herein incorporated by reference in their entireties.

FIELD

The present invention is directed to compositions concerning mutant *Clostridium difficile* toxins and methods thereof.

BACKGROUND

*Clostridium difficile* (*C. difficile*) is a Gram-positive anaerobic bacterium that is associated with gastrointestinal disease in humans. Colonization of *C. difficile* usually occurs in the colon if the natural gut flora is diminished by treatment with antibiotics. An infection can lead to antibiotic-associated diarrhea and sometimes pseudomembranous colitis through the secretion of the glucosylating toxins, toxin A and toxin B (308 and 270 kDa, respectively), which are the primary virulence factors of *C. difficile*.

Toxin A and toxin B are encoded within the 19 kb pathogenicity locus (PaLoc) by the genes tcdA and tcdB, respectively. Nonpathogenic strains of *C. difficile* have this locus replaced by an alternative 115 base pair sequence.

Both toxin A and toxin B are potent cytotoxins. These proteins are homologous glucosyltransferases that inactivate small GTPases of the Rho/Rac/Ras family. The resulting disruption in signaling causes a loss of cell-cell junctions, dysregulation of the actin cytoskeleton, and/or apoptosis, resulting in the profound secretory diarrhea that is associated with *Clostridium difficile* infections (CU).

In the last decade, the numbers and severity of *C. difficile* outbreaks in hospitals, nursing homes, and other long-term care facilities increased dramatically. Key factors in this escalation include emergence of hypervirulent pathogenic strains, increased use of antibiotics, improved detection methods, and increased exposure to airborne spores in health care facilities.

Metronidazole and vancomycin represent the currently accepted standard of care for the antibiotic treatment of *C. difficile* associated disease (CDAD). However, about 20% of patients receiving such treatment experience a recurrence of infection after a first episode of CU, and up to about 50% of those patients suffer from additional recurrences. Treatment of recurrences represents a very significant challenge, and the majority of recurrences usually occur within one month of the preceding episode.

Accordingly, there is a need for immunogenic and/or therapeutic compositions and methods thereof directed to *C. difficile*.

SUMMARY OF THE INVENTION

These and other objectives are provided by the invention herein.

In one aspect, the invention relates to an immunogenic composition that includes a mutant *C. difficile* toxin A. The mutant *C. difficile* toxin A includes a glucosyltransferase domain having at least one mutation and a cysteine protease domain having at least one mutation, relative to the corresponding wild-type *C. difficile* toxin A. In one embodiment, at least one amino acid of the mutant *C. difficile* toxin A is chemically crosslinked.

In one aspect, the invention relates to an isolated polypeptide including the amino acid sequence set forth in SEQ ID NO: 4, wherein the methionine residue at position 1 is optionally not present, and wherein the polypeptide includes at least one amino acid side chain chemically modified by 1-ethyl-3-(3-dimethylaminopropyl) carbodiimide) (EDC) and N-Hydroxysuccinimide (NHS).

In one embodiment, at least one amino acid of the mutant *C. difficile* toxin is chemically crosslinked.

In one embodiment, the at least one amino acid amino acid is chemically crosslinked by formaldehyde, 1-ethyl-3-(3-dimethylaminopropyl) carbodiimide (EDC), N-hydroxysuccinate, or a combination of EDC and NHS.

In one embodiment, the immunogenic composition is recognized by a respective anti-toxin neutralizing antibody or binding fragment thereof.

In one embodiment, the immunogenic composition exhibits decreased cytotoxicity, relative to the corresponding wild-type *C. difficile* toxin.

In another aspect, the invention relates to an immunogenic composition that includes a mutant *C. difficile* toxin A, which includes a glucosyltransferase domain having SEQ ID NO: 29, which has an amino acid substitution at positions 285 and 287, and a cysteine protease domain having SEQ ID NO: 32, which has an amino acid substitution at position 158, relative to the corresponding wild-type *C. difficile* toxin A, wherein at least one amino acid of the mutant *C. difficile* toxin A is chemically crosslinked.

In a further aspect, the invention relates to an immunogenic composition that includes a mutant *C. difficile* toxin A, which includes SEQ ID NO: 4, wherein at least one amino acid of the mutant *C. difficile* toxin A is chemically crosslinked.

In yet another aspect, the invention relates to an immunogenic composition that includes SEQ ID NO: 4, SEQ ID NO: 5, SEQ ID NO: 6, SEQ ID NO: 7, or SEQ ID NO: 8.

In one aspect, the invention relates to an immunogenic composition that includes a mutant *C. difficile* toxin B. The mutant *C. difficile* toxin B includes a glucosyltransferase domain having at least one mutation and a cysteine protease domain having at least one mutation, relative to the corresponding wild-type *C. difficile* toxin B.

In another aspect, the invention relates to an isolated polypeptide including the amino acid sequence set forth in SEQ ID NO: 6, wherein the methionine residue at position 1 is optionally not present, and wherein the polypeptide includes an amino acid side chain chemically modified by 1-ethyl-3-(3-dimethylaminopropyl) carbodiimide) (EDC) and N-Hydroxysuccinimide (NHS).

In another aspect, the invention relates to an immunogenic composition that includes a mutant *C. difficile* toxin B, which includes a glucosyltransferase domain having SEQ ID NO: 31, which has an amino acid substitution at positions 286 and 288, and a cysteine protease domain having SEQ ID NO: 33, which has an amino acid substitution at position 155, relative to the corresponding wild-type *C. difficile* toxin B, wherein at least one amino acid of the mutant *C. difficile* toxin B is chemically crosslinked.

In a further aspect, the invention relates to an immunogenic composition that includes a mutant *C. difficile* toxin B, which includes SEQ ID NO: 6, wherein at least one amino acid of the mutant *C. difficile* toxin B is chemically crosslinked.

In one aspect, the invention relates to an immunogenic composition that includes a mutant *C. difficile* toxin A, which includes SEQ ID NO: 4, and a mutant *C. difficile* toxin B, which includes SEQ ID NO: 6, wherein at least one amino acid of each of the mutant *C. difficile* toxins is chemically crosslinked.

In further aspects, the invention relates to a recombinant cell or progeny thereof, that includes a polynucleotide encoding any of the foregoing mutant *C. difficile* toxins, wherein the cell lacks an endogenous polynucleotide encoding a toxin.

In another aspect, the invention relates to an antibody or antibody binding fragment thereof specific to an immunogenic composition that includes a mutant *C. difficile* toxin.

In one aspect, the invention relates to a method of treating a *C. difficile* infection in a mammal. The method includes administering to the mammal an immunogenic composition that includes a mutant *C. difficile* toxin A, which includes SEQ ID NO: 4, and a mutant *C. difficile* toxin B, which includes SEQ ID NO: 6, wherein at least one amino acid of each of the mutant *C. difficile* toxins is crosslinked by formaldehyde.

In another aspect, the method of treating a *C. difficile* infection in a mammal includes administering to the mammal an immunogenic composition that includes a mutant *C. difficile* toxin A, which includes SEQ ID NO: 4, and a mutant *C. difficile* toxin B, which includes SEQ ID NO: 6, wherein at least one amino acid of each of the mutant *C. difficile* toxins is crosslinked by 1-ethyl-3-(3-dimethylaminopropyl) carbodiimide and/or N-Hydroxysuccinimide (NHS).

In one aspect, the invention relates to a method of inducing an immune response to a *C. difficile* infection in a mammal. The method includes administering to the mammal an immunogenic composition that includes a mutant *C. difficile* toxin A, which includes SEQ ID NO: 4, and a mutant *C. difficile* toxin B, which includes SEQ ID NO: 6, wherein at least one amino acid of each of the mutant *C. difficile* toxins is crosslinked by formaldehyde.

In another aspect, the method of inducing an immune response to a *C. difficile* infection in a mammal includes administering to the mammal an immunogenic composition that includes a mutant *C. difficile* toxin A, which includes SEQ ID NO: 4, and a mutant *C. difficile* toxin B, which includes SEQ ID NO: 6, wherein at least one amino acid of each of the mutant *C. difficile* toxins is crosslinked by 1-ethyl-3-(3-dimethylaminopropyl) carbodiimide and/or N-Hydroxysuccinimide (NHS).

In one embodiment, the methods of treating or the methods of inducing an immune response is in a mammal in need thereof.

In one embodiment, the methods of treating or the methods of inducing an immune response includes a mammal that has had a recurring *C. difficile* infection.

In one embodiment, the methods of treating or the methods of inducing an immune response includes parenterally administering the composition.

In one embodiment, the methods of treating or the methods of inducing an immune response includes an immunogenic composition that further includes an adjuvant.

In one embodiment, the adjuvant includes aluminum hydroxide gel and a CpG oligonucleotide. In another embodiment, the adjuvant includes ISCOMATRIX.

In one embodiment, the isolated polypeptide includes at least one side chain of an aspartic acid residue of the polypeptide or at least one side chain of a glutamic acid residue of the polypeptide is chemically modified by glycine.

In one embodiment, the isolated polypeptide includes at least one crosslink between a side chain of an aspartic acid residue of the polypeptide and a side chain of a lysine residue of the polypeptide; and at least one crosslink between a side chain of a glutamic acid residue of the polypeptide and a side chain of a lysine residue of the polypeptide.

In one embodiment, the isolated polypeptide includes a beta-alanine moiety linked to a side chain of at least one lysine residue of the polypeptide.

In one embodiment, the isolated polypeptide includes a glycine moiety linked to a side chain of an aspartic acid residue of the polypeptide or to a side chain of a glutamic acid residue of the polypeptide.

In one embodiment, the isolated polypeptide includes the amino acid sequence set forth in SEQ ID NO: 4, wherein the methionine residue at position 1 is optionally not present, and wherein a side chain of at least one lysine residue of the polypeptide is linked to a beta-alanine moiety.

In one embodiment, the isolated polypeptide includes the amino acid sequence set forth in SEQ ID NO: 6, wherein the methionine residue at position 1 is optionally not present, and wherein a side chain of at least one lysine residue of the polypeptide is linked to a beta-alanine moiety.

In one embodiment, the isolated polypeptide includes a side chain of a second lysine residue of the polypeptide is linked to a side chain of an aspartic acid residue or to a side chain of a glutamic acid residue.

In one embodiment, the isolated polypeptide includes a side chain of an aspartic acid residue or a side chain of a glutamic acid residue of the polypeptide is linked to a glycine moiety.

In one embodiment, the isolated polypeptide has an $EC_{50}$ of at least about 100 µg/ml.

In one aspect, the immunogenic composition includes an isolated polypeptide having the amino acid sequence set forth in SEQ ID NO: 4, wherein the methionine residue at position 1 is optionally not present, and an isolated polypeptide having the amino acid sequence set forth in SEQ ID NO: 6, wherein the methionine residue at position 1 is optionally not present, and wherein the polypeptides have at least one amino acid side chain chemically modified by 1-ethyl-3-(3-dimethylaminopropyl) carbodiimide) (EDC) and N-Hydroxysuccinimide (NHS).

In one embodiment, the polypeptide includes at least one of any of: a) a) at least one beta-alanine moiety linked to a side chain of a lysine residue of the polypeptide; b) at least one crosslink between a side chain of a lysine residue of the polypeptide and a side chain of an aspartic acid residue; and c) at least one crosslink between a side chain of a lysine residue of the polypeptide and a side chain of a glutamic acid residue.

In one embodiment, the isolated polypeptide has an $EC_{50}$ of at least about 100 µg/ml.

In one aspect, the immunogenic composition includes an isolated polypeptide having the amino acid sequence set forth in SEQ ID NO: 4, wherein the methionine residue at position 1 is optionally not present, and an isolated polypeptide having the amino acid sequence set forth in SEQ ID NO: 6, wherein the methionine residue at position 1 is optionally not present, and a) wherein a side chain of at least one lysine residue of SEQ ID NO: 4 is linked to a beta-alanine moiety, and b) wherein a side chain of at least one lysine residue of SEQ ID NO: 6 is linked to a beta-alanine moiety.

In one embodiment, the immunogenic composition includes a side chain of a second lysine residue of SEQ ID NO: 4 is linked to a side chain of an aspartic acid residue or to a side chain of a glutamic acid residue, and wherein a second lysine residue of SEQ ID NO: 6 is linked to a side chain of an aspartic acid residue or to a side chain of a glutamic acid residue.

In one embodiment, the immunogenic composition includes a side chain of an aspartic acid residue or a side chain of a glutamic acid residue of the polypeptide having the amino acid sequence set forth in SEQ ID NO: 4, wherein the methionine residue at position 1 is optionally not present, is linked to a glycine moiety.

In one embodiment, the immunogenic composition includes a side chain of an aspartic acid residue or a side chain of a glutamic acid residue of the polypeptide having the amino acid sequence set forth in SEQ ID NO: 6, wherein the methionine residue at position 1 is optionally not present, is linked to a glycine moiety.

In one embodiment, the isolated polypeptide has an $EC_{50}$ of at least about 100 μg/ml.

In one aspect, the immunogenic composition includes an isolated polypeptide having the amino acid sequence set forth in SEQ ID NO: 84 and an isolated polypeptide having the amino acid sequence set forth in SEQ ID NO: 86, wherein each polypeptide includes a) at least one crosslink between a side chain of an aspartic acid residue of the polypeptide and a side chain of a lysine residue of the polypeptide; b) at least one crosslink between a side chain of a glutamic acid residue of the polypeptide and a side chain of a lysine residue of the polypeptide; c) a beta-alanine moiety linked to a side chain of at least one lysine residue of the polypeptide; and d) a glycine moiety linked to a side chain of at least one aspartic acid residue of the polypeptide or to a side chain of at least one glutamic acid residue of the polypeptide.

BRIEF DESCRIPTION OF DRAWINGS

FIG. 1A-H: Sequence alignment of wild-type *C. difficile* toxin A from strains 630, VPI10463, R20291, CD196, and mutant toxin A having SEQ ID NO: 4, using CLUSTALW alignment, default parameters.

FIG. 2A-F: Sequence alignment of wild-type *C. difficile* toxin B from strains 630, VPI10463, R20291, CD196, and mutant toxin B having SEQ ID NO: 6, using CLUSTALW alignment, default parameters.

FIGS. 4A and B: SDS-PAGE results illustrating that triple mutant A (SEQ ID NO: 4), double mutant B (SEQ ID NO: 5), and triple mutant B (SEQ ID NO: 6) do not glucosylate Rac1 or RhoA GTPases in an in vitro glucosylation assays with UDP-$^{14}$C-glucose; whereas 10 μg to 1 ng of wild type toxin B does glucosylate Rac1.

FIG. 6: Graphs showing that triple mutant toxins A and B (SEQ ID NOs: 4 and 6, respectively) exhibit residual cytotoxicity when tested at high concentrations (e.g., about 100 μg/ml) by in vitro cytotoxicity assay in IMR-90 cells.

FIG. 15: Graph showing relative neutralizing antibody response against different formulations of *C. difficile* mutant toxins in hamsters (study ham*C. difficile*2010-03), as described in Example 29.

FIG. 16A-B: Graphs showing strong relative neutralizing antibody response against chemically inactivated genetic mutant toxins A and B (SEQ ID NOs: 4 and 6, respectively) in cynomolgus macaques, as described in Example 30.

FIG. 17: Amino acid sequences of variable regions of light (VL) and heavy (HL) chains of A3-25 mAb IgE. Signal peptide—highlighted; CDRs—italicized and underlined; Constant region—bolded and underlined (complete sequence not shown).

FIG. 20A-C: Synergistic neutralizing activities of combinations of toxin A mAbs: Adding different dilutions of neutralizing antibodies A60-22, A65-33, and A80-29 to increasing concentrations of A3-25 mAb synergistically increased the neutralization of toxin A regardless of the dilution. The RLUs of the toxin A only ($4 \times EC_{50}$) control is illustrated ($<0.3 \times 10^6$) and cell only controls were $2-2.5 \times 10^6$ RLUs as depicted in graphs shown in FIG. 20B and FIG. 20C.

FIG. 21: Synergistic neutralizing activities of toxin B mAbs: Neutralization of toxin B by mAbs 8-26, B60-2 and B59-3 is illustrated in FIG. 21A. Neutralization of toxin B is synergistically increased after combining B8-26 with dilutions of B59-3 (FIG. 21B)

FIG. 23A-K: Graph representing results from in vitro cytotoxicity tests in which the ATP levels (RLUs) are plotted against increasing concentrations of C. difficile culture media and the hamster serum pool (■); crude toxin (culture harvest) from the respective strain and the hamster serum pool (●); purified toxin (commercial toxin obtained from List Biologicals) and the hamster serum pool (▲); crude toxin (▼), control; and purified toxin (♦), control. The toxins from the respective strains were added to the cells at 4×EC$_{50}$ values.

BRIEF DESCRIPTION OF SEQUENCES

Figure 3:
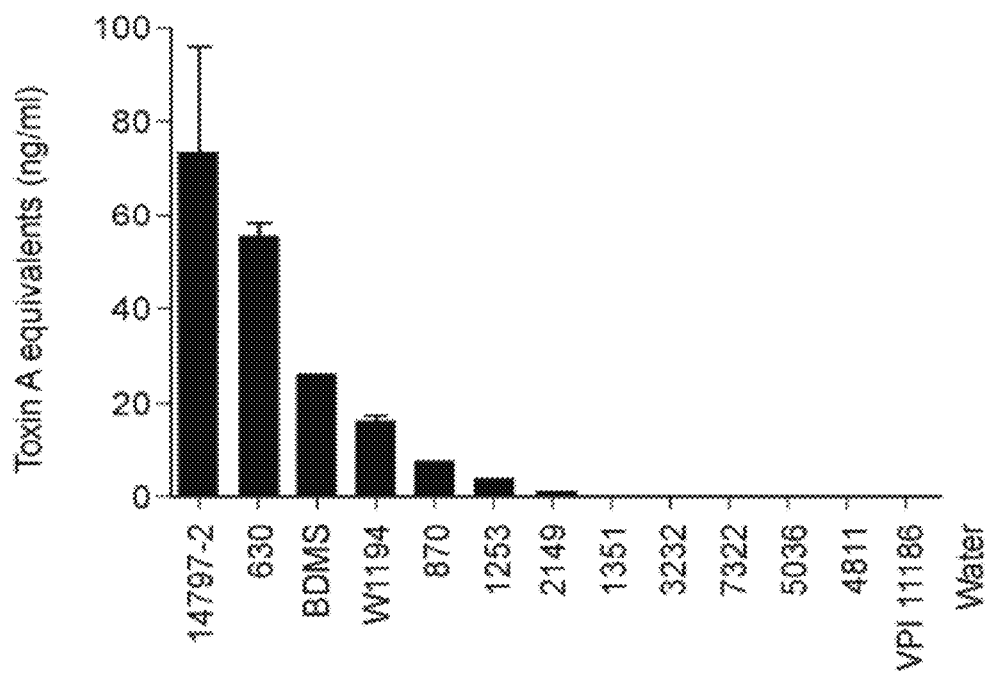
FIG. 3: Graph showing identification of wild-type toxin-negative *C. difficile* strains. Culture media of 13 *C. difficile* strains were tested by ELISA for toxin A. As illustrated, seven strains expressed toxin A and 6 strains did not (strains 1351, 3232, 7322, 5036, 4811 and VPI 11186).

SEQ ID NO: 1 sets forth the amino acid sequence for wild-type C. difficile 630 toxin A (TcdA).

SEQ ID NO: 2 sets forth the amino acid sequence for wild-type C. difficile 630 toxin B (TcdB).

SEQ ID NO: 3 sets forth the amino acid sequence for a mutant TcdA having a mutation at positions 285 and 287, as compared to SEQ ID NO: 1.

SEQ ID NO: 4 sets forth the amino acid sequence for a mutant TcdA having a mutation at positions 285, 287, and 700, as compared to SEQ ID NO: 1.

SEQ ID NO: 5 sets forth the amino acid sequence for a mutant TcdB having a mutation at positions 286 and 288, as compared to SEQ ID NO: 2.

SEQ ID NO: 6 sets forth the amino acid sequence for a mutant TcdB having a mutation at positions 286, 288, and 698, as compared to SEQ ID NO: 2.

SEQ ID NO: 7 sets forth the amino acid sequence for a mutant TcdA having a mutation at positions 269, 272, 285, 287, 460, 462, and 700, as compared to SEQ ID NO: 1

SEQ ID NO: 8 sets forth the amino acid sequence for a mutant TcdB having a mutation at positions 270, 273, 286, 288, 461, 463, and 698, as compared to SEQ ID NO: 2

SEQ ID NO: 9 sets forth a DNA sequence encoding a wild-type C. difficile 630 toxin A (TcdA).

SEQ ID NO: 10 sets forth a DNA sequence encoding a wild-type C. difficile 630 toxin B (TcdB).

SEQ ID NO: 11 sets forth a DNA sequence encoding SEQ ID NO: 3

SEQ ID NO: 12 sets forth a DNA sequence encoding SEQ ID NO: 4

SEQ ID NO: 13 sets forth a DNA sequence encoding SEQ ID NO: 5

SEQ ID NO: 14 sets forth a DNA sequence encoding SEQ ID NO: 6

SEQ ID NO: 15 sets forth the amino acid sequence for wild-type C. difficile R20291 TcdA.

SEQ ID NO: 16 sets forth a DNA sequence encoding SEQ ID NO: 15.

SEQ ID NO: 17 sets forth the amino acid sequence for wild-type C. difficile CD196 TcdA.

SEQ ID NO: 18 sets forth a DNA sequence encoding SEQ ID NO: 17.

SEQ ID NO: 19 sets forth the amino acid sequence for wild-type C. difficile VPI10463 TcdA.

SEQ ID NO: 20 sets forth a DNA sequence encoding SEQ ID NO: 19.

SEQ ID NO: 21 sets forth the amino acid sequence for wild-type C. difficile R20291 TcdB.

SEQ ID NO: 22 sets forth a DNA sequence encoding SEQ ID NO: 21.

SEQ ID NO: 23 sets forth the amino acid sequence for wild-type C. difficile CD196 TcdB.

SEQ ID NO: 24 sets forth a DNA sequence encoding SEQ ID NO: 23.

SEQ ID NO: 25 sets forth the amino acid sequence for wild-type C. difficile VPI10463 TcdB.

SEQ ID NO: 26 sets forth a DNA sequence encoding SEQ ID NO: 25.

SEQ ID NO: 27 sets forth a DNA sequence of a pathogenicity locus of wild-type C. difficile VPI10463.

SEQ ID NO: 28 sets forth the amino acid sequence for residues 101 to 293 of SEQ ID NO: 1.

SEQ ID NO: 29 sets forth the amino acid sequence for residues 1 to 542 of SEQ ID NO:

SEQ ID NO: 30 sets forth the amino acid sequence for residues 101 to 293 of SEQ ID NO: 2.

SEQ ID NO: 31 sets forth the amino acid sequence for residues 1 to 543 of SEQ ID NO: 2.

SEQ ID NO: 32 sets forth the amino acid sequence for residues 543 to 809 of SEQ ID NO: 1.

SEQ ID NO: 33 sets forth the amino acid sequence for residues 544 to 767 of SEQ ID NO: 2.

SEQ ID NO: 34 sets forth the amino acid sequence for a mutant TcdA, wherein residues 101, 269, 272, 285, 287, 460, 462, 541, 542, 543, 589, 655, and 700 may be any amino acid.

SEQ ID NO: 35 sets forth the amino acid sequence for a mutant TcdB, wherein 102, 270, 273, 286, 288, 384, 461, 463, 520, 543, 544, 587, 600, 653, 698, and 751 may be any amino acid.

SEQ ID NO: 36 sets forth the amino acid sequence for the variable light chain of a neutralizing antibody of C. difficile TcdA (A3-25 mAb).

SEQ ID NO: 37 sets forth the amino acid sequence for the variable heavy chain of a neutralizing antibody of *C. difficile* TcdA (A3-25 mAb).

SEQ ID NO: 38 sets forth the amino acid sequence for CDR1 of the variable light chain of neutralizing antibody of *C. difficile* TcdA (A3-25 mAb).

SEQ ID NO: 39 sets forth the amino acid sequence for CDR2 of the variable light chain of neutralizing antibody of *C. difficile* TcdA (A3-25 mAb).

SEQ ID NO: 40 sets forth the amino acid sequence for CDR3 of the variable light chain of neutralizing antibody of *C. difficile* TcdA (A3-25 mAb).

SEQ ID NO: 41 sets forth the amino acid sequence for CDR1 of the variable heavy chain of neutralizing antibody of *C. difficile* TcdA (A3-25 mAb).

SEQ ID NO: 42 sets forth the amino acid sequence for CDR2 of the variable heavy chain of neutralizing antibody of *C. difficile* TcdA (A3-25 mAb).

SEQ ID NO: 43 sets forth the amino acid sequence for CDR3 of the variable heavy chain of neutralizing antibody of *C. difficile* TcdA (A3-25 mAb).

SEQ ID NO: 44 sets forth a DNA sequence encoding SEQ ID NO: 3.

SEQ ID NO: 45 sets forth a DNA sequence encoding SEQ ID NO: 4.

SEQ ID NO: 46 sets forth a DNA sequence encoding SEQ ID NO: 5.

SEQ ID NO: 47 sets forth a DNA sequence encoding SEQ ID NO: 6.

SEQ ID NO: 48 sets forth the nucleotide sequence of immunostimulatory oligonucleotide ODN CpG 24555.

SEQ ID NO: 49 sets forth the amino acid sequence for the variable heavy chain of a *C. difficile* TcdB neutralizing antibody (B8-26 mAb).

SEQ ID NO: 50 sets forth the amino acid sequence for the signal peptide of the variable heavy chain of a *C. difficile* TcdB neutralizing antibody (B8-26 mAb).

SEQ ID NO: 51 sets forth the amino acid sequence for CDR1 of the variable heavy chain of a *C. difficile* TcdB neutralizing antibody (B8-26 mAb).

SEQ ID NO: 52 sets forth the amino acid sequence for CDR2 of the variable heavy chain of a *C. difficile* TcdB neutralizing antibody (B8-26 mAb).

SEQ ID NO: 53 sets forth the amino acid sequence for CDR3 of the variable heavy chain of a *C. difficile* TcdB neutralizing antibody (B8-26 mAb).

SEQ ID NO: 54 sets forth the amino acid sequence for the constant region of the variable heavy chain of a *C. difficile* TcdB neutralizing antibody (B8-26 mAb).

SEQ ID NO: 55 sets forth the amino acid sequence for the variable light chain of a *C. difficile* TcdB neutralizing antibody (B8-26 mAb).

SEQ ID NO: 56 sets forth the amino acid sequence for the signal peptide of the variable light chain of a *C. difficile* TcdB neutralizing antibody (B8-26 mAb).

SEQ ID NO: 57 sets forth the amino acid sequence for CDR1 of the variable light chain of a *C. difficile* TcdB neutralizing antibody (B8-26 mAb).

SEQ ID NO: 58 sets forth the amino acid sequence for CDR2 of the variable light chain of a *C. difficile* TcdB neutralizing antibody (B8-26 mAb).

SEQ ID NO: 59 sets forth the amino acid sequence for CDR3 of the variable light chain of a *C. difficile* TcdB neutralizing antibody (B8-26 mAb).

SEQ ID NO: 60 sets forth the amino acid sequence for the variable heavy chain of a *C. difficile* TcdB neutralizing antibody (B59-3 mAb).

SEQ ID NO: 61 sets forth the amino acid sequence for the signal peptide of the variable heavy chain of a *C. difficile* TcdB neutralizing antibody (B59-3 mAb).

SEQ ID NO: 62 sets forth the amino acid sequence for CDR1 of the variable heavy chain of a *C. difficile* TcdB neutralizing antibody (B59-3 mAb).

SEQ ID NO: 63 sets forth the amino acid sequence for CDR2 of the variable heavy chain of a *C. difficile* TcdB neutralizing antibody (B59-3 mAb).

SEQ ID NO: 64 sets forth the amino acid sequence for CDR3 of the variable heavy chain of a *C. difficile* TcdB neutralizing antibody (B59-3 mAb).

SEQ ID NO: 65 sets forth the amino acid sequence for the constant region of the variable heavy chain of a *C. difficile* TcdB neutralizing antibody (B59-3 mAb).

SEQ ID NO: 66 sets forth the amino acid sequence for the variable light chain of a *C. difficile* TcdB neutralizing antibody (B59-3 mAb).

SEQ ID NO: 67 sets forth the amino acid sequence for the signal peptide of the variable light chain of a *C. difficile* TcdB neutralizing antibody (B59-3 mAb).

SEQ ID NO: 68 sets forth the amino acid sequence for CDR1 of the variable light chain of a *C. difficile* TcdB neutralizing antibody (B59-3 mAb).

SEQ ID NO: 69 sets forth the amino acid sequence for CDR2 of the variable light chain of a *C. difficile* TcdB neutralizing antibody (B59-3 mAb).

SEQ ID NO: 70 sets forth the amino acid sequence for CDR3 of the variable light chain of a *C. difficile* TcdB neutralizing antibody (B59-3 mAb).

SEQ ID NO: 71 sets forth the amino acid sequence for the variable heavy chain of a *C. difficile* TcdB neutralizing antibody (B9-30 mAb).

SEQ ID NO: 72 sets forth the amino acid sequence for the signal peptide of the variable heavy chain of a *C. difficile* TcdB neutralizing antibody (B9-30 mAb).

SEQ ID NO: 73 sets forth the amino acid sequence for CDR1 of the variable heavy chain of a *C. difficile* TcdB neutralizing antibody (B9-30 mAb).

SEQ ID NO: 74 sets forth the amino acid sequence for CDR2 of the variable heavy chain of a *C. difficile* TcdB neutralizing antibody (B9-30 mAb).

SEQ ID NO: 75 sets forth the amino acid sequence for CDR3 of the variable heavy chain of a *C. difficile* TcdB neutralizing antibody (B9-30 mAb).

SEQ ID NO: 76 sets forth the amino acid sequence for the constant region of the variable heavy chain of a *C. difficile* TcdB neutralizing antibody (B9-30 mAb).

SEQ ID NO: 77 sets forth the amino acid sequence for the variable light chain of a *C. difficile* TcdB neutralizing antibody (B9-30 mAb).

SEQ ID NO: 78 sets forth the amino acid sequence for the signal peptide of the variable light chain of a *C. difficile* TcdB neutralizing antibody (B9-30 mAb).

SEQ ID NO: 79 sets forth the amino acid sequence for CDR1 of the variable light chain of a *C. difficile* TcdB neutralizing antibody (B9-30 mAb).

SEQ ID NO: 80 sets forth the amino acid sequence for CDR2 of the variable light chain of a *C. difficile* TcdB neutralizing antibody (B9-30 mAb).

SEQ ID NO: 81 sets forth the amino acid sequence for CDR3 of the variable light chain of a *C. difficile* TcdB neutralizing antibody (B9-30 mAb).

SEQ ID NO: 82 sets forth the amino acid sequence for a mutant TcdB, wherein a residue at positions 102, 270, 273, 286, 288, 384, 461, 463, 520, 543, 544, 587, 600, 653, 698, and 751 may be any amino acid.

SEQ ID NO: 83 sets forth the amino acid sequence for a mutant TcdA having a mutation at positions 269, 272, 285, 287, 460, 462, and 700, as compared to SEQ ID NO: 1, wherein the methionine at position 1 is absent.

SEQ ID NO: 84 sets forth the amino acid sequence for a mutant *C. difficile* toxin A having a mutation at positions 285, 287, and 700, as compared to SEQ ID NO: 1, wherein the methionine at position 1 is absent.

SEQ ID NO: 85 sets forth the amino acid sequence for a mutant *C. difficile* toxin B having a mutation at positions 270, 273, 286, 288, 461, 463, and 698, as compared to SEQ ID NO: 2, wherein the methionine at position 1 is absent.

SEQ ID NO: 86 sets forth the amino acid sequence for a mutant *C. difficile* toxin B having a mutation at positions 286, 288, and 698, as compared to SEQ ID NO: 2, wherein the methionine at position 1 is absent.

SEQ ID NO: 87 sets forth the amino acid sequence for wild-type *C. difficile* 2004013 TcdA.

SEQ ID NO: 88 sets forth the amino acid sequence for wild-type *C. difficile* 2004111 TcdA.

SEQ ID NO: 89 sets forth the amino acid sequence for wild-type *C. difficile* 2004118 TcdA.

SEQ ID NO: 90 sets forth the amino acid sequence for wild-type *C. difficile* 2004205 TcdA.

SEQ ID NO: 91 sets forth the amino acid sequence for wild-type *C. difficile* 2004206 TcdA.

SEQ ID NO: 92 sets forth the amino acid sequence for wild-type *C. difficile* 2005022 TcdA.

SEQ ID NO: 93 sets forth the amino acid sequence for wild-type *C. difficile* 2005088 TcdA.

SEQ ID NO: 94 sets forth the amino acid sequence for wild-type *C. difficile* 2005283 TcdA.

SEQ ID NO: 95 sets forth the amino acid sequence for wild-type *C. difficile* 2005325 TcdA.

SEQ ID NO: 96 sets forth the amino acid sequence for wild-type *C. difficile* 2005359 TcdA.

SEQ ID NO: 97 sets forth the amino acid sequence for wild-type *C. difficile* 2006017 TcdA.

SEQ ID NO: 98 sets forth the amino acid sequence for wild-type *C. difficile* 2007070 TcdA.

SEQ ID NO: 99 sets forth the amino acid sequence for wild-type *C. difficile* 2007217 TcdA.

SEQ ID NO: 100 sets forth the amino acid sequence for wild-type *C. difficile* 2007302 TcdA.

SEQ ID NO: 101 sets forth the amino acid sequence for wild-type *C. difficile* 2007816 TcdA.

SEQ ID NO: 102 sets forth the amino acid sequence for wild-type *C. difficile* 2007838 TcdA.

SEQ ID NO: 103 sets forth the amino acid sequence for wild-type *C. difficile* 2007858 TcdA.

SEQ ID NO: 104 sets forth the amino acid sequence for wild-type *C. difficile* 2007886 TcdA.

SEQ ID NO: 105 sets forth the amino acid sequence for wild-type *C. difficile* 2008222 TcdA.

SEQ ID NO: 106 sets forth the amino acid sequence for wild-type *C. difficile* 2009078 TcdA.

SEQ ID NO: 107 sets forth the amino acid sequence for wild-type *C. difficile* 2009087 TcdA.

SEQ ID NO: 108 sets forth the amino acid sequence for wild-type *C. difficile* 2009141 TcdA.

SEQ ID NO: 109 sets forth the amino acid sequence for wild-type *C. difficile* 2009292 TcdA.

SEQ ID NO: 110 sets forth the amino acid sequence for wild-type *C. difficile* 2004013 TcdB.

SEQ ID NO: 111 sets forth the amino acid sequence for wild-type *C. difficile* 2004111 TcdB.

SEQ ID NO: 112 sets forth the amino acid sequence for wild-type *C. difficile* 2004118 TcdB.

SEQ ID NO: 113 sets forth the amino acid sequence for wild-type *C. difficile* 2004205 TcdB.

SEQ ID NO: 114 sets forth the amino acid sequence for wild-type *C. difficile* 2004206 TcdB.

SEQ ID NO: 115 sets forth the amino acid sequence for wild-type *C. difficile* 2005022 TcdB.

SEQ ID NO: 116 sets forth the amino acid sequence for wild-type *C. difficile* 2005088 TcdB.

SEQ ID NO: 117 sets forth the amino acid sequence for wild-type *C. difficile* 2005283 TcdB.

SEQ ID NO: 118 sets forth the amino acid sequence for wild-type *C. difficile* 2005325 TcdB.

SEQ ID NO: 119 sets forth the amino acid sequence for wild-type *C. difficile* 2005359 TcdB.

SEQ ID NO: 120 sets forth the amino acid sequence for wild-type *C. difficile* 2006017 TcdB.

SEQ ID NO: 121 sets forth the amino acid sequence for wild-type *C. difficile* 2006376 TcdB.

SEQ ID NO: 122 sets forth the amino acid sequence for wild-type *C. difficile* 2007070 TcdB.

SEQ ID NO: 123 sets forth the amino acid sequence for wild-type *C. difficile* 2007217 TcdB.

SEQ ID NO: 124 sets forth the amino acid sequence for wild-type *C. difficile* 2007302 TcdB.

SEQ ID NO: 125 sets forth the amino acid sequence for wild-type *C. difficile* 2007816 TcdB.

SEQ ID NO: 126 sets forth the amino acid sequence for wild-type *C. difficile* 2007838 TcdB.

SEQ ID NO: 127 sets forth the amino acid sequence for wild-type *C. difficile* 2007858 TcdB.

SEQ ID NO: 128 sets forth the amino acid sequence for wild-type *C. difficile* 2007886 TcdB.

SEQ ID NO: 129 sets forth the amino acid sequence for wild-type *C. difficile* 2008222 TcdB.

SEQ ID NO: 130 sets forth the amino acid sequence for wild-type *C. difficile* 2009078 TcdB.

SEQ ID NO: 131 sets forth the amino acid sequence for wild-type *C. difficile* 2009087 TcdB.

SEQ ID NO: 132 sets forth the amino acid sequence for wild-type *C. difficile* 2009141 TcdB.

SEQ ID NO: 133 sets forth the amino acid sequence for wild-type *C. difficile* 2009292 TcdB.

SEQ ID NO: 134 sets forth the amino acid sequence for wild-type *C. difficile* 014 TcdA.

SEQ ID NO: 135 sets forth the amino acid sequence for wild-type *C. difficile* 015 TcdA.

SEQ ID NO: 136 sets forth the amino acid sequence for wild-type *C. difficile* 020 TcdA.

SEQ ID NO: 137 sets forth the amino acid sequence for wild-type *C. difficile* 023 TcdA.

SEQ ID NO: 138 sets forth the amino acid sequence for wild-type *C. difficile* 027 TcdA.

SEQ ID NO: 139 sets forth the amino acid sequence for wild-type *C. difficile* 029 TcdA.

SEQ ID NO: 140 sets forth the amino acid sequence for wild-type *C. difficile* 046 TcdA.

SEQ ID NO: 141 sets forth the amino acid sequence for wild-type *C. difficile* 014 TcdB.

SEQ ID NO: 142 sets forth the amino acid sequence for wild-type *C. difficile* 015 TcdB.

SEQ ID NO: 143 sets forth the amino acid sequence for wild-type *C. difficile* 020 TcdB.
SEQ ID NO: 144 sets forth the amino acid sequence for wild-type *C. difficile* 023 TcdB.
SEQ ID NO: 145 sets forth the amino acid sequence for wild-type *C. difficile* 027 TcdB.
SEQ ID NO: 146 sets forth the amino acid sequence for wild-type *C. difficile* 029 TcdB.
SEQ ID NO: 147 sets forth the amino acid sequence for wild-type *C. difficile* 046 TcdB.
SEQ ID NO: 148 sets forth the amino acid sequence for wild-type *C. difficile* 001 TcdA.
SEQ ID NO: 149 sets forth the amino acid sequence for wild-type *C. difficile* 002 TcdA.
SEQ ID NO: 150 sets forth the amino acid sequence for wild-type *C. difficile* 003 TcdA.
SEQ ID NO: 151 sets forth the amino acid sequence for wild-type *C. difficile* 004 TcdA.
SEQ ID NO: 152 sets forth the amino acid sequence for wild-type *C. difficile* 070 TcdA.
SEQ ID NO: 153 sets forth the amino acid sequence for wild-type *C. difficile* 075 TcdA.
SEQ ID NO: 154 sets forth the amino acid sequence for wild-type *C. difficile* 077 TcdA.
SEQ ID NO: 155 sets forth the amino acid sequence for wild-type *C. difficile* 081 TcdA.
SEQ ID NO: 156 sets forth the amino acid sequence for wild-type *C. difficile* 117 TcdA.
SEQ ID NO: 157 sets forth the amino acid sequence for wild-type *C. difficile* 131 TcdA.
SEQ ID NO: 158 sets forth the amino acid sequence for wild-type *C. difficile* 001 TcdB.
SEQ ID NO: 159 sets forth the amino acid sequence for wild-type *C. difficile* 002 TcdB.
SEQ ID NO: 160 sets forth the amino acid sequence for wild-type *C. difficile* 003 TcdB.
SEQ ID NO: 161 sets forth the amino acid sequence for wild-type *C. difficile* 004 TcdB.
SEQ ID NO: 162 sets forth the amino acid sequence for wild-type *C. difficile* 070 TcdB.
SEQ ID NO: 163 sets forth the amino acid sequence for wild-type *C. difficile* 075 TcdB.
SEQ ID NO: 164 sets forth the amino acid sequence for wild-type *C. difficile* 077 TcdB.
SEQ ID NO: 165 sets forth the amino acid sequence for wild-type *C. difficile* 081 TcdB.
SEQ ID NO: 166 sets forth the amino acid sequence for wild-type *C. difficile* 117 TcdB.
SEQ ID NO: 167 sets forth the amino acid sequence for wild-type *C. difficile* 131 TcdB.
SEQ ID NO: 168 sets forth the amino acid sequence for wild-type *C. difficile* 053 TcdA.
SEQ ID NO: 169 sets forth the amino acid sequence for wild-type *C. difficile* 078 TcdA.
SEQ ID NO: 170 sets forth the amino acid sequence for wild-type *C. difficile* 087 TcdA.
SEQ ID NO: 171 sets forth the amino acid sequence for wild-type *C. difficile* 095 TcdA.
SEQ ID NO: 172 sets forth the amino acid sequence for wild-type *C. difficile* 126 TcdA.
SEQ ID NO: 173 sets forth the amino acid sequence for wild-type *C. difficile* 053 TcdB.
SEQ ID NO: 174 sets forth the amino acid sequence for wild-type *C. difficile* 078 TcdB.
SEQ ID NO: 175 sets forth the amino acid sequence for wild-type *C. difficile* 087 TcdB.
SEQ ID NO: 176 sets forth the amino acid sequence for wild-type *C. difficile* 095 TcdB.
SEQ ID NO: 177 sets forth the amino acid sequence for wild-type *C. difficile* 126 TcdB.

DETAILED DESCRIPTION

The inventors surprisingly discovered, among other things, a mutant *C. difficile* toxin A and toxin B, and methods thereof. The mutants are characterized, in part, by being immunogenic and exhibiting reduced cytotoxicity compared to a wild-type form of the respective toxin. The present invention also relates to immunogenic portions thereof, biological equivalents thereof, and isolated polynucleotides that include nucleic acid sequences encoding any of the foregoing.

The immunogenic compositions described herein unexpectedly demonstrated the ability to elicit novel neutralizing antibodies against *C. difficile* toxins and they may have the ability to confer active and/or passive protection against a *C. difficile* challenge. The novel antibodies are directed against various epitopes of toxin A and toxin B. The inventors further discovered that a combination of at least two of the neutralizing monoclonal antibodies can exhibit an unexpectedly synergistic effect in respective in vitro neutralization of toxin A and toxin B.

The inventive compositions described herein may be used to treat, prevent, decrease the risk of, decrease occurrences of, decrease severity of, and/or delay the outset of a *C. difficile* infection, *C. difficile* associated disease (CDAD), syndrome, condition, symptom, and/or complication thereof in a mammal, as compared to a mammal to which the composition was not administered.

Moreover, the inventors discovered a recombinant asporogenic *C. difficile* cell that can stably express the mutant *C. difficile* toxin A and toxin B, and novel methods for producing the same.

Immunogenic Compositions

In one aspect, the invention relates to an immunogenic composition that includes a mutant *C. difficile* toxin. The mutant *C. difficile* toxin includes an amino acid sequence having at least one mutation in a glucosyltransferase domain and at least one mutation in a cysteine protease domain, relative to the corresponding wild-type *C. difficile* toxin.

The term "wild-type," as used herein, refers to the form found in nature. For example, a wild-type polypeptide or polynucleotide sequence is a sequence present in an organism that can be isolated from a source in nature and which has not been intentionally modified by human manipulation. The present invention also relates to isolated polynucleotides that include nucleic acid sequences encoding any of the foregoing. In addition, the present invention relates to use of any of the foregoing compositions to treat, prevent, decrease the risk of, decrease severity of, decrease occurrences of, and/or delay the outset of a *C. difficile* infection, *C. difficile* associated disease, syndrome, condition, symptom, and/or complication thereof in a mammal, as compared to a mammal to which the composition is not administered, as well as methods for preparing said compositions.

As used herein, an "immunogenic composition" or "immunogen" refers to a composition that elicits an immune response in a mammal to which the composition is administered.

An "immune response" refers to the development of a beneficial humoral (antibody mediated) and/or a cellular (mediated by antigen-specific T cells or their secretion products)

response directed against a *C. difficile* toxin in a recipient patient. The immune response may be humoral, cellular, or both.

The immune response can be an active response induced by administration of an immunogenic composition, an immunogen. Alternatively, the immune response can be a passive response induced by administration of antibody or primed T-cells.

The presence of a humoral (antibody-mediated) immune response can be determined, for example, by cell-based assays known in the art, such as a neutralizing antibody assay, ELISA, etc.

A cellular immune response is typically elicited by the presentation of polypeptide epitopes in association with Class I or Class II MHC molecules to activate antigen-specific CD4+T helper cells and/or CD8+cytotoxic T cells. The response may also involve activation of monocytes, macrophages, NK cells, basophils, dendritic cells, astrocytes, microglia cells, eosinophils or other components of innate immunity. The presence of a cell-mediated immunological response can be determined by proliferation assays (CD4+T cells) or CTL (cytotoxic T lymphocyte) assays known in the art.

In one embodiment, an immunogenic composition is a vaccine composition. As used herein, a "vaccine composition" is a composition that elicits an immune response in a mammal to which the composition is administered. The vaccine composition may protect the immunized mammal against subsequent challenge by an immunizing agent or an immunologically cross-reactive agent. Protection can be complete or partial with regard to reduction in symptoms or infection as compared to a non-vaccinated mammal under the same conditions.

The immunogenic compositions described herein are cross-reactive, which refers to having a characteristic of being able to elicit an effective immune response (e.g., humoral immune response) against a toxin produced by another *C. difficile* strain that is different from the strain from which the composition is derived. For example, the immunogenic compositions (e.g., derived from *C. difficile* 630) described herein may elicit cross-reactive antibodies that can bind to toxins produced by multiple strains of *C. difficile* (e.g., toxins produced by *C. difficile* R20291 and VPI10463). See, for example, Example 37. Cross-reactivity is indicative of the cross-protection potential of the bacterial immunogen, and vice versa.

The term "cross-protective" as used herein refers to the ability of the immune response induced by an immunogenic composition to prevent or attenuate infection by a different bacterial strain or species of the same genus. For example, an immunogenic composition (e.g., derived from *C. difficile* 630) described herein may induce an effective immune response in a mammal to attenuate a *C. difficile* infection and/or to attenuate a *C. difficile* disease caused by a strain other than 630 (e.g., *C. difficile* R20291) in the mammal.

Exemplary mammals in which the immunogenic composition or immunogen elicits an immune response include any mammals, such as, for example, mice, hamsters, primates, and humans. In a preferred embodiment, the immunogenic composition or immunogen elicits an immune response in a human to which the composition is administered.

As described above, toxin A (TcdA) and toxin B (TcdB) are homologous glucosyltransferases that inactivate small GTPases of the Rho/Rac/Ras family. The action of TcdA and TcdB on mammalian target cells depends on a multistep mechanism of receptor-mediated endocytosis, membrane translocation, autoproteolytic processing, and monoglucosylation of GTPases. Many of these functional activities have been ascribed to discrete regions within the primary sequence of the toxins, and the toxins have been imaged to show that these molecules are similar in structure.

The wild-type gene for TcdA has about 8130 nucleotides that encode a protein having a deduced molecular weight of about 308-kDa, having about 2710 amino acids. As used herein, a wild-type *C. difficile* TcdA includes a *C. difficile* TcdA from any wild-type *C. difficile* strain. A wild-type *C. difficile* TcdA may include a wild-type *C. difficile* TcdA amino acid sequence having at least about 90%, 91%, 92%, 93%, 94%, 95%, 96%, 97%, preferably about 98%, more preferably about 99% or most preferably about 100% identity to SEQ ID NO: 1 (full length) when optimally aligned, such as by the programs GAP or BESTFIT using default gap weights.

In a preferred embodiment, the wild-type *C. difficile* TcdA includes an amino acid sequence set forth in SEQ ID NO: 1, which describes the wild-type amino acid sequence for TcdA from *C. difficile* strain 630 (also disclosed in GenBank accession number YP_001087137.1 and/or CAJ67494.1). *C. difficile* strain 630 is known in the art as being a PCR-ribotype 012 strain. SEQ ID NO: 9 describes the wild-type gene for TcdA from *C. difficile* strain 630, which is also disclosed in GenBank accession number NC_009089.1.

Another example of a wild-type *C. difficile* TcdA includes an amino acid sequence set forth in SEQ ID NO: 15, which describes the wild-type amino acid sequence for TcdA from *C. difficile* strain R20291 (also disclosed in GenBank accession number YP_003217088.1). *C. difficile* strain R20291 is known in the art as being a hypervirulent strain and a PCR-ribotype 027 strain. The amino acid sequence for TcdA from *C. difficile* strain R20291 has about 98% identity to SEQ ID NO:1. SEQ ID NO: 16 describes the wild-type gene for TcdA from *C. difficile* strain R20291, which is also disclosed in GenBank accession number NC_013316.1.

An additional example of a wild-type *C. difficile* TcdA includes an amino acid sequence set forth in SEQ ID NO: 17, which describes the wild-type amino acid sequence for TcdA from *C. difficile* strain CD196 (also disclosed in GenBank accession number CBA61156.1). CD196 is a strain from a recent Canadian outbreak, and it is known in the art as a PCR-ribotype 027 strain. The amino acid sequence for TcdA from *C. difficile* strain CD196 has about 98% identity to SEQ ID NO: 1, and has about 100% identity to TcdA from *C. difficile* strain R20291. SEQ ID NO: 18 describes the wild-type gene for TcdA from *C. difficile* strain CD196, which is also disclosed in GenBank accession number FN538970.1.

Further examples of an amino acid sequence for a wild-type *C. difficile* TcdA include SEQ ID NO: 19, which describes the wild-type amino acid sequence for TcdA from *C. difficile* strain VPI10463 (also disclosed in GenBank accession number CAA63564.1). The amino acid sequence for TcdA from *C. difficile* strain VPI10463 has about 100% (99.8%) identity to SEQ ID NO: 1. SEQ ID NO: 20 describes the wild-type gene for TcdA from *C. difficile* strain VPI10463, which is also disclosed in GenBank accession number X92982.1.

Additional examples of a wild-type *C. difficile* TcdA include TcdA from wild-type *C. difficile* strains obtainable from the Centers for Disease Control and Prevention (CDC, Atlanta, Ga.). The inventors discovered that the amino acid sequence of TcdA from wild-type *C. difficile* strains obtainable from the CDC include at least about 99.3% to 100% identity, when optimally aligned, to amino acid residues 1 to 821 of SEQ ID NO: 1 (TcdA from *C. difficile* 630). See Table 1.

The inventors also discovered that the amino acid sequence of TcdA from wild-type *C. difficile* strains may include at least about 90%, 91%, 92%, 93%, 94%, 95%, 96%, 97%, 98%, 99%, to about 100% identity, when optimally aligned (e.g., when full, length sequences are optimally aligned) to SEQ ID NO: 1.

TABLE 1 wild-type *C. difficile* strains obtained from CDC and the percent identity of amino acid residues 1-821 of TcdA from the respective wild-type *C. difficile* strain to amino acid residues 1-821 of SEQ ID NO: 1, when optimally aligned.
Table 1: Wild-type *C. difficile* Strains from CDC

| *C. difficile* Strain ID | Approximate % Amino Acid Identity to Residues 1-821 of SEQ ID NO: 1 |
|---|---|
| 2004111 | 100 |
| 2004118 | 99.6 |
| 2004205 | 100 |
| 2004206 | 100 |
| 2005325 | 99.3 |
| 2005359 | 99.6 |
| 2006017 | 100 |
| 2007070 | 100 |
| 2007302 | 100 |
| 2007816 | 99.3 |
| 2007838 | 99.6 |
| 2007886 | 99.6 |
| 2008222 | 100 |
| 2009078 | 100 |
| 2009087 | 100 |
| 2009141 | 100 |
| 2009292 | 99.6 |

Accordingly, in one embodiment, the wild-type *C. difficile* TcdA amino acid sequence includes a sequence of at least about 500, 600, 700, or 800 contiguous residues, which has at least about 90%, 91%, 92%, 93%, 94%, 95%, 96%, 97%, preferably about 98%, more preferably about 99%, or most preferably about 100% identity to a sequence of equal length between residues 1 to 900 of SEQ ID NO: 1 when optimally aligned, such as by the programs GAP or BESTFIT using default gap weights. Examples include strains described above (e.g., R20291, CD196, etc) and those listed in Table 1.

In another embodiment, the wild-type *C. difficile* TcdA amino acid sequence includes a sequence having at least about 90%, 91%, 92%, 93%, 94%, 95%, 96%, preferably about 97%, preferably about 98%, more preferably about 99% or most preferably about 100% identity to any sequence selected from SEQ ID NOs: 87-109 when optimally aligned. See Table 1-a.

TABLE 1-a

Wild-type *C. difficile* Strains

| *C. difficile* Strain ID | Toxin A, SEQ ID NO: |
|---|---|
| 2004013 | SEQ ID NO: 87 |
| 2004111 | SEQ ID NO: 88 |
| 2004118 | SEQ ID NO: 89 |
| 2004205 | SEQ ID NO: 90 |
| 2004206 | SEQ ID NO: 91 |
| 2005022 | SEQ ID NO: 92 |
| 2005088 | SEQ ID NO: 93 |
| 2005283 | SEQ ID NO: 94 |
| 2005325 | SEQ ID NO: 95 |
| 2005359 | SEQ ID NO: 96 |
| 2006017 | SEQ ID NO: 97 |
| 2006376 | N/A |
| 2007070 | SEQ ID NO: 98 |
| 2007217 | SEQ ID NO: 99 |
| 2007302 | SEQ ID NO: 100 |
| 2007816 | SEQ ID NO: 101 |
| 2007838 | SEQ ID NO: 102 |
| 2007858 | SEQ ID NO: 103 |
| 2007886 | SEQ ID NO: 104 |
| 2008222 | SEQ ID NO: 105 |
| 2009078 | SEQ ID NO: 106 |
| 2009087 | SEQ ID NO: 107 |
| 2009141 | SEQ ID NO: 108 |
| 2009292 | SEQ ID NO: 109 |
| 001 | SEQ ID NO: 148 |
| 002 | SEQ ID NO: 149 |
| 003 | SEQ ID NO: 150 |
| 012 (004) | SEQ ID NO: 151 |
| 014 | SEQ ID NO: 134 |
| 015 | SEQ ID NO: 135 |
| 017 | |
| 020 | SEQ ID NO: 136 |
| 023 | SEQ ID NO: 137 |
| 027 | SEQ ID NO: 138 |
| 029 | SEQ ID NO: 139 |
| 046 | SEQ ID NO: 140 |
| 053 | SEQ ID NO: 168 |
| 059 | |
| 070 | SEQ ID NO: 152 |
| 075 | SEQ ID NO: 153 |
| 077 | SEQ ID NO: 154 |
| 078 | SEQ ID NO: 169 |
| 081 | SEQ ID NO: 155 |
| 087 | SEQ ID NO: 170 |
| 095 | SEQ ID NO: 171 |
| 106 | |
| 117 | SEQ ID NO: 156 |
| 126 | SEQ ID NO: 172 |
| 131 | SEQ ID NO: 157 |

The wild-type gene for TcdB has about 7098 nucleotides that encode a protein with a deduced molecular weight of about 270 kDa, having about 2366 amino acids. As used herein, a wild-type *C. difficile* TcdB includes a *C. difficile* TcdB from any wild-type *C. difficile* strain. A wild-type *C. difficile* TcdB may include a wild-type amino acid sequence having at least about 90%, 91%, 92%, 93%, 94%, 95%, 96%, 97%, preferably about 98%, more preferably about 99% or most preferably about 100% identity to SEQ ID NO: 2 when optimally aligned, such as by the programs GAP or BESTFIT using default gap weights. In a preferred embodiment, the wild-type *C. difficile* TcdB includes an amino acid sequence set forth in SEQ ID NO: 2, which describes the wild-type amino acid sequence for TcdB from *C. difficile* strain 630 (also disclosed in GenBank accession number YP_001087135.1 and/or CAJ67492). SEQ ID NO: 10 describes the wild-type gene for TcdB from *C. difficile* strain 630, which is also disclosed in GenBank accession number NC_009089.1.

Another example of a wild-type *C. difficile* TcdB includes an amino acid sequence set forth in SEQ ID NO: 21, which describes the wild-type amino acid sequence for TcdB from *C. difficile* strain R20291 (also disclosed in GenBank accession number YP_003217086.1 and/or CBE02479.1). The amino acid sequence for TcdB from *C. difficile* strain R20291 has about 92% identity to SEQ ID NO: 2. SEQ ID NO: 22 describes the wild-type gene for TcdB from *C. difficile* strain R20291, which is also disclosed in GenBank accession number NC_013316.1.

An additional example of a wild-type *C. difficile* TcdB includes an amino acid sequence set forth in SEQ ID NO: 23, which describes the wild-type amino acid sequence for TcdB from *C. difficile* strain CD196 (also disclosed in GenBank accession number YP_003213639.1 and/or CBA61153.1). SEQ ID NO: 24 describes the wild-type gene for TcdB from *C. difficile* strain CD196, which is also disclosed in GenBank accession number NC_013315.1. The amino acid sequence for TcdB from *C. difficile* strain CD196 has about 92% identity to SEQ ID NO: 2.

Further examples of an amino acid sequence for a wild-type *C. difficile* TcdB include SEQ ID NO: 25, which describes the wild-type amino acid sequence for TcdB from *C. difficile* strain VPI10463 (also disclosed in GenBank accession number P18177 and/or CAA37298). The amino acid sequence for TcdB from *C. difficile* strain VPI10463 has 100% identity to SEQ ID NO: 2. SEQ ID NO: 26 describes the wild-type gene for TcdB from *C. difficile* strain VPI10463, which is also disclosed in GenBank accession number X53138.1.

Additional examples of a wild-type *C. difficile* TcdB include TcdB from wild-type *C. difficile* strains obtainable from the Centers for Disease Control and Prevention (CDC, Atlanta, Ga.). The inventors discovered that the amino acid sequence of TcdB from wild-type *C. difficile* strains obtainable from the CDC include at least about 96% to 100% identity, when optimally aligned, to amino acid residue 1 to 821 of SEQ ID NO: 2 (TcdB from *C. difficile* 630). See Table 2.

TABLE 2 wild-type *C. difficile* strains obtained from CDC and the % identity of amino acid residues 1-821 of TcdB from the respective wild-type *C. difficile* strain to amino acid residues 1-821 of SEQ ID NO: 2, when optimally aligned.
Table 2: Wild-type *C. difficile* Strains from CDC

| C. difficile Strain ID | Approximate % Amino Acid Identity to Residues 1-821 of SEQ ID NO: 2 |
|---|---|
| 2004013 | 96.0 |
| 2004111 | 100 |
| 2004118 | 96.0 |
| 2004206 | 100 |
| 2005022 | 100 |
| 2005325 | 96.7 |
| 2007302 | 100 |
| 2007816 | 96.7 |
| 2008222 | 100 |
| 2009078 | 100 |
| 2009087 | 100 |
| 2009141 | 100 |

Accordingly, in one embodiment, a wild-type *C. difficile* TcdB amino acid sequence includes a sequence of at least about 500, 600, 700, or 800 contiguous residues, which has at least about 90%, 91%, 92%, 93%, 94%, 95%, 96%, preferably about 97%, preferably about 98%, more preferably about 99% or most preferably about 100% identity to a sequence of equal length between residues 1 to 900 of SEQ ID NO: 2 when optimally aligned, such as by the programs GAP or BESTFIT using default gap weights. Examples include strains described above (e.g., R20291, CD196, etc) and those listed in Table 2.

In another embodiment, the wild-type *C. difficile* TcdB amino acid sequence includes a sequence having at least about 90%, 91%, 92%, 93%, 94%, 95%, 96%, preferably about 97%, preferably about 98%, more preferably about 99% or most preferably about 100% identity to any sequence selected from SEQ ID NOs: 110-133 when optimally aligned. See Table 2-a.

TABLE 2-a

Wild-type *C. difficile* Strains

| C. difficile Strain ID | Toxin B, SEQ ID NO: |
|---|---|
| 2004013 | SEQ ID NO: 110 |
| 2004111 | SEQ ID NO: 111 |
| 2004118 | SEQ ID NO: 112 |
| 2004205 | SEQ ID NO: 113 |
| 2004206 | SEQ ID NO: 114 |
| 2005022 | SEQ ID NO: 115 |
| 2005088 | SEQ ID NO: 116 |
| 2005283 | SEQ ID NO: 117 |
| 2005325 | SEQ ID NO: 118 |
| 2005359 | SEQ ID NO: 119 |
| 2006017 | SEQ ID NO: 120 |
| 2006376 | SEQ ID NO: 121 |
| 2007070 | SEQ ID NO: 122 |
| 2007217 | SEQ ID NO: 123 |
| 2007302 | SEQ ID NO: 124 |
| 2007816 | SEQ ID NO: 125 |
| 2007838 | SEQ ID NO: 126 |
| 2007858 | SEQ ID NO: 127 |
| 2007886 | SEQ ID NO: 128 |
| 2008222 | SEQ ID NO: 129 |
| 2009078 | SEQ ID NO: 130 |
| 2009087 | SEQ ID NO: 131 |
| 2009141 | SEQ ID NO: 132 |
| 2009292 | SEQ ID NO: 133 |
| 001 | SEQ ID NO: 158 |
| 002 | SEQ ID NO: 159 |
| 003 | SEQ ID NO: 160 |
| 012 (004) | SEQ ID NO: 161 |
| 014 | SEQ ID NO: 141 |
| 015 | SEQ ID NO: 142 |
| 017 | |
| 020 | SEQ ID NO: 143 |
| 023 | SEQ ID NO: 144 |
| 027 | SEQ ID NO: 145 |
| 029 | SEQ ID NO: 146 |
| 046 | SEQ ID NO: 147 |
| 053 | SEQ ID NO: 173 |
| 059 | |
| 070 | SEQ ID NO: 162 |
| 075 | SEQ ID NO: 163 |
| 077 | SEQ ID NO: 164 |
| 078 | SEQ ID NO: 174 |
| 081 | SEQ ID NO: 165 |
| 087 | SEQ ID NO: 175 |
| 095 | SEQ ID NO: 176 |
| 106 | |
| 117 | SEQ ID NO: 166 |
| 126 | SEQ ID NO: 177 |
| 131 | SEQ ID NO: 167 |

The genes for toxins A and B (tcdA and tcdB) are part of a 19.6-kb genetic locus (the pathogenicity locus, PaLoc) that includes 3 additional small open-reading frames (ORFS), tcdD, tcdE, and tcdC, and may be considered useful for virulence. The PaLoc is known to be stable and conserved in toxigenic strains. It is present at the same chromosomal integration site in all toxigenic strains that have been analyzed to date. In nontoxigenic strains, the pathogenicity locus (PaLoc) is not present. Accordingly, a characteristic of the wild-type *C. difficile* strains described herein is the presence of a pathogenicity locus. Another preferred characteristic of the wild-type *C. difficile* strains described herein is the production of both TcdA and TcdB.

In one embodiment, the wild-type *C. difficile* strain is a strain having a pathogenicity locus that is at least about 90%, 91%, 92%, 93%, 94%, 95%, 96%, 97%, preferably about 98%, more preferably about 99% or most preferably about 100% identical to that of *C. difficile* 630 or VPI10463. The total pathogenicity locus sequence of *C. difficile* VPI10463, is registered at the EMBL database with the sequence accession number X92982, also shown in SEQ ID NO: 26. Strains in which the PaLoc is identical to that of the reference strain VPI10463 are referred to as toxinotype 0. Strains of toxinotypes I-VII, IX, XII-XV, and XVIII-XXIV produce both TcdA and TcdB despite variations in their toxin genes.

At the N-terminus of the toxins, the glucosyltransferase domain is located. The glucosyltransferase activity of the toxins is associated with the cytotoxic function of the toxins. Without being bound by mechanism or theory, the glucosyltransferase activity in both toxins is believed to catalyze the monoglucosylation of small GTP-binding proteins in the Rho/Rac/Ras superfamily. After glucosylation of these GTP binding proteins, cellular physiology is modified dramatically, resulting in a loss of structural integrity and disruption of essential signaling pathways of the host cells infected by the toxins. The Asp-Xaa-Asp (DXD) motif, which is involved with manganese, uridine diphosphate (UDP), and glucose binding, is a typical characteristic for the glucosyltransferase domain. Without being bound by mechanism or theory, it is believed that residues critical for catalytic activity, such as the DXD motif, do not vary between a TcdB from a known "historical" strain, such as 630, and a TcdB from a hypervirulent strain, such as R20291. The DXD motif is located at residues 285 to 287 of a wild-type C. difficile TcdA, according to the numbering of SEQ ID NO: 1, and at residues 286 to 288 of a wild-type C. difficile TcdB, according to the numbering of SEQ ID NO: 2.

Global alignment algorithms (e.g., sequence analysis programs) are known in the art and may be used to optimally align two or more amino acid toxin sequences to determine if the toxin includes a particular signature motif (e.g., DXD in the glucosyltransferase domain, DHC in the cysteine protease domain described below, etc.). The optimally aligned sequence(s) are compared to a respective reference sequence (e.g., SEQ ID NO:1 for TcdA or SEQ ID NO: 2 for TcdB) to determine the existence of the signature motif. "Optimal alignment" refers to an alignment giving the highest percent identity score. Such alignment can be performed using known sequence analysis programs. In one embodiment, a CLUSTAL alignment (such as CLUSTALW) under default parameters is used to identify suitable wild-type toxins by comparing the query sequence against the reference sequence. The relative numbering of the conserved amino acid residues is based on the residue numbering of the reference amino acid sequence to account for small insertions or deletions (for example, five amino acids of less) within the aligned sequence.

As used herein, the term "according to the numbering of" refers to the numbering of the residues of a reference sequence when the given amino acid or polynucleotide sequence is compared to the reference sequence. In other words, the number or residue position of a given polymer is designated with respect to the reference sequence rather than by the actual numerical position of the residue within the given amino acid or polynucleotide sequence.

For example, a given amino acid sequence, such as that of a hypervirulent wild-type C. difficile strain, can be aligned to a reference sequence (e.g., such as that of a historical wild-type C. difficile strain, e.g., 630) by introducing gaps, if necessary, to optimize residue matches between the two sequences. In these cases, although the gaps are present, the numbering of the residue in the given amino acid or polynucleotide sequence is made with respect to the reference sequence to which it has been aligned. As used herein, a "reference sequence" refers to a defined sequence used as a basis for a sequence comparison.

Unless stated otherwise, all references herein to amino acid positions of a TcdA refer to the numbering of SEQ ID NO: 1.

Unless stated otherwise, all references herein to amino acid positions of a TcdB refer to the numbering of SEQ ID NO: 2.

The glucosyltransferase domain of TcdA, as used herein, may begin at exemplary residue 1, 101, or 102, and may end at exemplary residue 542, 516, or 293 of a wild-type C. difficile TcdA, e.g., SEQ ID NO: 1. Any minimum residue position may be combined with a maximum residue position between residues 1 and 542 of TcdA to define a sequence for the glucosyltransferase domain as long as the DXD motif region is included. For example, in one embodiment, the glucosyltransferase domain of TcdA includes SEQ ID NO: 27, which is identical to residues 101-293 of SEQ ID NO: 1, and it includes the DXD motif region. In another embodiment, the glucosyltransferase domain of TcdA includes SEQ ID NO: 28, which is identical to residues 1-542 of SEQ ID NO: 1.

The glucosyltransferase domain of TcdB, as used herein, may begin at exemplary residue 1, 101, or 102, and may end at exemplary residue 543, 516, or 293 of a wild-type C. difficile TcdB, e.g., SEQ ID NO: 2. Any minimum residue position may be combined with a maximum residue position between residues 1 and 543 of TcdB to define a sequence for the glucosyltransferase domain as long as the DXD motif region is included. For example, in one embodiment, the glucosyltransferase domain of TcdB includes SEQ ID NO: 29, which is identical to residues 101-293 of SEQ ID NO: 2, and it includes the DXD motif region. In another embodiment, the glucosyltransferase domain of TcdB includes SEQ ID NO: 30, which is identical to residues 1-543 of SEQ ID NO: 2.

Without being bound to theory or mechanism, it is believed that the N-terminus of TcdA and/or TcdB is cleaved by an autoproteolytic process for the glucosyltransferase domain to be translocated and released into the host cell cytosol, where it can interact with Rac/Ras/Rho GTPases. Wild-type C. difficile TcdA has been shown to be cleaved between L542 and S543. Wild-type C. difficile TcdB has been shown to be cleaved between L543 and G544.

The cysteine protease domain is associated with the autocatalytic proteolytic activity of the toxin. The cysteine protease domain is located downstream of the glucosyltransferase domain and may be characterized by the catalytic triad aspartate, histidine, and cysteine (DHC), e.g., D589, H655, and C700 of a wild-type TcdA, and D587, H653, and C698 of a wild-type TcdB. Without being bound by mechanism or theory, it is believed that the catalytic triad is conserved between a toxin from a "historical" strain, such as 630, and a TcdB from a hypervirulent strain, such as R20291.

The cysteine protease domain of TcdA, as used herein, may begin at exemplary residue 543, and may end at exemplary residue 809 769, 768, or 767 of a wild-type TcdA, e.g., SEQ ID NO: 1. Any minimum residue position may be combined with a maximum residue position between 543 and 809 of a wild-type TcdA to define a sequence for the cysteine protease domain as long as the catalytic triad DHC motif region is included. For example, in one embodiment, the cysteine protease domain of TcdA includes SEQ ID NO: 32, which has the DHC motif region located at residues 47, 113, and 158 of SEQ ID NO: 32, which respectively correspond to D589, H655, and C700 of a wild-type TcdA according to the numbering of SEQ ID NO: 1. SEQ ID NO: 32 is identical to residues 543 to 809 of SEQ ID NO: 1, TcdA.

The cysteine protease domain of TcdB, as used herein, may begin at exemplary residue 544, and may end at exemplary residue 801, 767, 755, or 700 of a wild-type TcdB, e.g., SEQ ID NO: 2. Any minimum residue position may be combined with a maximum residue position between 544 and 801 of a wild-type TcdB to define a sequence for the cysteine protease domain as long as the catalytic triad DHC motif region is included. For example, in one embodiment, the cysteine protease domain of TcdB includes SEQ ID NO: 33, which includes the DHC motif region located at residues 44, 110, and 115 of SEQ ID NO: 33, which respectively correspond to D587, H653, and C698 of a wild-type TcdB according to the numbering of SEQ ID NO: 2. SEQ ID NO: 33 is identical to residues 544 to 767 of SEQ ID NO: 2, TcdB. In another embodiment, the cysteine protease domain of TcdB includes residues 544-801 of SEQ ID NO: 2, TcdB.

In the present invention, the immunogenic composition includes a mutant C. difficile toxin. The term "mutant," as used herein, refers to a molecule that exhibits a structure or sequence that differs from the corresponding wild-type structure or sequence, e.g., by having crosslinks as compared to the corresponding wild-type structure and/or by having at least one mutation, as compared to the corresponding wild-type sequence when optimally aligned, such as by the programs GAP or BESTFIT using default gap weights. The term "mutant" as used herein further includes a molecule that exhibits a functional property (e.g., abrogated glucosyltransferase and/or abrogated cysteine protease activity) that differs from the corresponding wild-type molecule.

A C. difficile toxin from any of the wild-type strains described above may be used as a source from which a mutant C. difficile toxin is produced. Preferably, C. difficile 630 is the source from which a mutant C. difficile toxin is produced.

The mutation may involve a substitution, deletion, truncation or modification of the wild type amino acid residue normally located at that position. Preferably, the mutation is a non-conservative amino acid substitution. The present invention also contemplates isolated polynucleotides that include nucleic acid sequences encoding any of the mutant toxins described herein.

A "non-conservative" amino acid substitution, as used herein, refers to an exchange of an amino acid from one class for an amino acid from another class, according to the following Table 3:

TABLE 3

Amino Acid Classes

| Class | Amino acid |
|---|---|
| Nonpolar: | Ala (A), Val (V), Leu (L), Ile (I), Pro (P), Met (M), Phe (F), Trp (W) |
| Uncharged polar: | Gly (G), Ser (S), Thr (T), Cys (C), Tyr (Y), Asn (N), Gln (Q) |
| Acidic: | Asp (D), Glu (E) |
| Basic: | Lys (K), Arg (R), His (H) |

Examples of a non-conservative amino acid substitution include a substitution wherein an aspartic acid residue (Asp, D) is replaced by an alanine residue (Ala, A). Other examples include replacing an aspartic acid residue (Asp, D) with an asparagine residue (Asn, N); replacing an arginine (Arg, R), glutamic acid (Glu, E), lysine (Lys, K), and/or histidine (His, H) residue with an alanine residue (Ala, A).

A conservative substitution refers to an exchange between amino acids from the same class, for example, according to Table 3.

The mutant toxins of the invention may be prepared by techniques known in the art for preparing mutations, such as, for example, site-directed mutagenesis, mutagenesis using a mutagen (e.g., UV light), etc. Preferably, site-directed mutagenesis is used. Alternatively, a nucleic acid molecule having an objective sequence may be directly synthesized. Such chemical synthesis methods are known in the art.

In the present invention, the mutant C. difficile toxin includes at least one mutation in a glucosyltransferase domain, relative to the corresponding wild-type C. difficile toxin. In one embodiment, the glucosyltransferase domain includes at least two mutations. Preferably, the mutation decreases or abrogates glucosyltransferase enzyme activity of the toxin, as compared to the glucosyltransferase enzyme activity of the corresponding wild-type C. difficile toxin.

Exemplary amino acid residues in a glucosyltransferase domain of TcdA that may undergo a mutation include at least one of the following, or any combination thereof: W101, D269, R272, D285, D287, E460, R462, S541, and L542, as compared to a wild-type C. difficile TcdA, according to the numbering of SEQ ID NO: 1.

Exemplary mutations in a glucosyltransferase domain of TcdA include at least one of the following, or any combination thereof: W101A, D269A, R272A, D285A, D287A, E460A, R462A, S541A, and L542G, as compared to a wild-type C. difficile TcdA. In a preferred embodiment, the glucosyltransferase domain of TcdA includes a L542G mutation, as compared to a wild-type C. difficile TcdA. In another preferred embodiment, the glucosyltransferase domain of TcdA includes a D285A and a D287A mutation, as compared to a wild-type C. difficile TcdA.

Exemplary amino acid residues in a glucosyltransferase domain of TcdB that may undergo a mutation include at least one of the following, or any combination thereof: W102, D270, R273, D286, D288, N384, D461, K463, W520, and L543, as compared to a wild-type C. difficile toxin B, according to the numbering of SEQ ID NO: 2.

Exemplary mutations in a glucosyltransferase domain of TcdB include at least one of the following, or any combination thereof: W102A, D270A, D270N, R273A, D286A, D288A, N384A, D461A, D461R, K463A, K463E, W520A, and L543A, as compared to a wild-type C. difficile TcdB. In a preferred embodiment, the glucosyltransferase domain of TcdB includes a L543A, as compared to a wild-type C. difficile TcdB. In another preferred embodiment, the glucosyltransferase domain of TcdB includes a D286A and a D288A mutation, as compared to a wild-type C. difficile TcdB.

Any of the mutations described herein above may be combined with a mutation in a cysteine protease domain. In the present invention, the mutant C. difficile toxin includes at least one mutation in a cysteine protease domain, relative to the corresponding wild-type C. difficile toxin. Preferably, the mutation decreases or abrogates cysteine protease activity of the toxin, as compared to the cysteine protease activity of the corresponding wild-type C. difficile toxin.

Exemplary amino acid residues in a cysteine protease domain of TcdA that may undergo a mutation include at least one of the following, or any combination thereof: S543, D589, H655, and C700, as compared to a wild-type C. difficile TcdA, according to the numbering of SEQ ID NO: 1. Exemplary mutations in a glucosyltransferase domain of TcdA include at least one of the following, or any combination thereof: S543A, D589A, D589N, H655A, C700A, as compared to a wild-type C. difficile TcdA. In a preferred embodiment, the cysteine protease domain of TcdA includes a C700A mutation, as compared to a wild-type C. difficile TcdA.

Exemplary amino acid residues in a cysteine protease domain of TcdB that may undergo a mutation include at least one of the following, or any combination thereof: G544, D587, H653, and C698, as compared to a wild-type C. difficile TcdB, according to the numbering of SEQ ID NO: 2. Exemplary mutations in a glucosyltransferase domain of TcdB include at least one of the following, or any combination thereof: G544A, D587A, D587N, H653A, C698A, as compared to a wild-type *C. difficile* TcdB. In a preferred embodiment, the cysteine protease domain of TcdB includes a C698A mutation, as compared to a wild-type *C. difficile* TcdB. Additional amino acid residues in a cysteine protease domain of TcdB that may undergo a mutation include: K600 and/or R751, as compared to a wild-type TcdB. Exemplary mutations include K600E and/or R751E.

Accordingly, the inventive mutant *C. difficile* toxin includes a glucosyltransferase domain having a mutation and a cysteine protease domain having a mutation, relative to the corresponding wild-type *C. difficile* toxin.

An exemplary mutant *C. difficile* TcdA includes a glucosyltransferase domain including SEQ ID NO: 29 having an amino acid substitution at positions 285 and 287, and a cysteine protease domain comprising SEQ ID NO: 32 having an amino acid substitution at position 158, relative to the corresponding wild-type *C. difficile* toxin A. For example, such a mutant *C. difficile* TcdA includes the amino acid sequence set forth in SEQ ID NO: 4, wherein the initial methionine is optionally not present. In another embodiment, the mutant mutant *C. difficile* toxin A includes the amino acid sequence set forth in SEQ ID NO: 84.

Further examples of a mutant *C. difficile* toxin A include the amino acid sequence set forth in SEQ ID NO: 7, which has a D269A, R272A, D285A, D287A, E460A, R462A, and C700A mutation, as compared to SEQ ID NO: 1, wherein the initial methionine is optionally not present. In another embodiment, the mutant mutant *C. difficile* toxin A includes the amino acid sequence set forth in SEQ ID NO: 83.

Another exemplary mutant TcdA includes SEQ ID NO: 34, wherein the residue at positions 101, 269, 272, 285, 287, 460, 462, 541, 542, 543, 589, 655, and 700 may be any amino acid.

In some embodiments, the mutant *C. difficile* toxin exhibits decreased or abrogated autoproteolytic processing as compared to the corresponding wild-type *C. difficile* toxin. For example, a mutant *C. difficile* TcdA may include a mutation at one of the following residues, or any combination thereof: S541, L542 and/or S543, as compared to the corresponding wild-type *C. difficile* TcdA. Preferably, the mutant *C. difficile* TcdA includes at least one of the following mutations, or any combination thereof: S541A, L542G, and S543A, as compared to the corresponding wild-type *C. difficile* TcdA.

Another exemplary mutant *C. difficile* TcdA includes a S541A, L542, S543 and C700 mutation, as compared to the corresponding wild-type *C. difficile* TcdA.

An exemplary mutant *C. difficile* toxin B includes a glucosyltransferase domain comprising SEQ ID NO: 31 having an amino acid substitution at positions 286 and 288, and a cysteine protease domain comprising SEQ ID NO: 33 having an amino acid substitution at position 155, relative to the corresponding wild-type *C. difficile* toxin B. For example, such a mutant *C. difficile* TcdB includes the amino acid sequence set forth in SEQ ID NO: 6, wherein the initial methionine is optionally not present. In another embodiment, the mutant mutant *C. difficile* toxin A includes the amino acid sequence set forth in SEQ ID NO: 86.

Further examples of a mutant *C. difficile* TcdB include the amino acid sequence set forth in SEQ ID NO: 8, which has a D270A, R273A, D286A, D288A, D461A, K463A, and C698A mutation, as compared to SEQ ID NO: 2. SEQ ID NO: 8 wherein the initial methionine is optionally not present. In another embodiment, the mutant mutant *C. difficile* toxin A includes the amino acid sequence set forth in SEQ ID NO: 85.

Another exemplary mutant TcdB includes SEQ ID NO: 35, wherein the residue at positions 101, 269, 272, 285, 287, 460, 462, 541, 542, 543, 589, 655, and 700 may be any amino acid.

As another example, a mutant *C. difficile* TcdB may include a mutation at positions 543 and/or 544, as compared to the corresponding wild-type *C. difficile* TcdB. Preferably, the mutant *C. difficile* TcdB includes a L543 and/or G544 mutation, as compared to the corresponding wild-type *C. difficile* TcdB. More preferably, the mutant *C. difficile* TcdB includes a L543G and/or G544A mutation, as compared to the corresponding wild-type *C. difficile* TcdB.

Another exemplary mutant *C. difficile* TcdB includes a L543G, G544A and C698 mutation, as compared to the corresponding wild-type *C. difficile* TcdB.

In one aspect, the invention relates to an isolated polypeptide having a mutation at any position from amino acid residue 1 to 1500 according to the numbering of SEQ ID NO: 2, to define an exemplary mutant *C. difficile* toxin B. For example, in one embodiment, the isolated polypeptide includes a mutation between amino acids residues 830 and 990 of SEQ ID NO: 2. Exemplary positions for mutations include positions 970 and 976 according to the numbering of SEQ ID NO: 2. Preferably, the mutation between residues 830 and 990 is a substitution. In one embodiment, the mutation is a non-conservative substitution wherein an Asp (D) and/or a Glu (E) amino acid residue is replaced by an amino acid residue that is not neutralized upon acidification, such as, for example, lysine (K), arginine (R), and histidine (H). Exemplary mutations include: E970K, E970R, E970H, E976K, E976R, E976H of SEQ ID NO: 2, to define a mutant *C. difficile* toxin B.

In another aspect, the invention relates to an isolated polypeptide having a mutation at any position from amino acid residue 1 to 1500 according to the numbering of SEQ ID NO: 1, to define an exemplary mutant *C. difficile* toxin A. For example, in one embodiment, the isolated polypeptide includes a mutation between amino acids residues 832 and 992 of SEQ ID NO: 1. Exemplary positions for mutations include positions 972 and 978 according to the numbering of SEQ ID NO: 1. Preferably, the mutation between residues 832 and 992 is a substitution. In one embodiment, the mutation is a non-conservative substitution wherein an Asp (D) and/or a Glu (E) amino acid residue is replaced by an amino acid residue that is not neutralized upon acidification, such as, for example, lysine (K), arginine (R), and histidine (H). Exemplary mutations include: D972K, D972R, D972H, D978K, D978R, D978H of SEQ ID NO: 1, to define a mutant *C. difficile* toxin A.

The polypeptides of the invention may include an initial methionine residue, in some cases as a result of a host cell-mediated process. Depending on, for example, the host cell used in a recombinant production procedure and/or the fermentation or growth conditions of the host cell, it is known in the art that the N-terminal methionine encoded by the translation initiation codon may be removed from a polypeptide after translation in cells or the N-terminal methionine may remain present in the isolated polypeptide.

Accordingly, in one aspect, the invention relates to an isolated polypeptide including the amino acid sequence set forth in SEQ ID NO: 4, wherein the initial methionine (at position 1) is optionally not present. In one embodiment, the initial methionine of SEQ ID NO: 4 is absent. In one aspect, the invention relates to an isolated polypeptide including the amino acid sequence set forth in SEQ ID NO: 84, which is identical to SEQ ID NO: 4, but for an absence of the initial methionine.

In another aspect, the isolated polypeptide includes the amino acid sequence set forth in SEQ ID NO: 6, wherein the initial methionine (at position 1) is optionally not present. In one embodiment, the initial methionine of SEQ ID NO: 6 is absent. In one aspect, the invention relates to an isolated polypeptide including the amino acid sequence set forth in SEQ ID NO: 86, which is identical to SEQ ID NO: 6, but for an absence of the initial methionine.

In a further aspect, the isolated polypeptide includes the amino acid sequence set forth in SEQ ID NO: 7, wherein the initial methionine (at position 1) is optionally not present. In one embodiment, the invention relates to an isolated polypeptide including the amino acid sequence set forth in SEQ ID NO: 83, which is identical to SEQ ID NO: 7, but for an absence of the initial methionine. In yet another aspect, the isolated polypeptide includes the amino acid sequence set forth in SEQ ID NO: 8, wherein the initial methionine (at position 1) is optionally not present. In one embodiment, the isolated polypeptide includes the amino acid sequence set forth in SEQ ID NO: 85, which is identical to SEQ ID NO: 8, but for an absence of the initial methionine.

In one aspect, the invention relates to an immunogenic composition including SEQ ID NO: 4, wherein the initial methionine (at position 1) is optionally not present. In another aspect, the invention relates to an immunogenic composition including SEQ ID NO: 6, wherein the initial methionine (at position 1) is optionally not present. In a further aspect, the invention relates to an immunogenic composition including SEQ ID NO: 7, wherein the initial methionine (at position 1) is optionally not present. In yet another aspect, the invention relates to an immunogenic composition including SEQ ID NO: 8, wherein the initial methionine (at position 1) is optionally not present.

In another aspect, the invention relates to an immunogenic composition including SEQ ID NO: 83. In one aspect, the invention relates to an immunogenic composition including SEQ ID NO: 84. In one aspect, the invention relates to an immunogenic composition including SEQ ID NO: 85. In another aspect, the invention relates to an immunogenic composition including SEQ ID NO: 86.

In addition to generating an immune response in a mammal, the immunogenic compositions described herein also have reduced cytotoxicity compared to the corresponding wild-type *C. difficile* toxin. Preferably, the immunogenic compositions are safe and have minimal (e.g., about a 6-8 $\log_{10}$ reduction) to no cytotoxicity, relative to the cytotoxicity of a respective wild-type toxin, for administration in mammals.

As used herein, the term cytotoxicity is a term understood in the art and refers to apoptotic cell death and/or a state in which one or more usual biochemical or biological functions of a cell are aberrantly compromised, as compared to an identical cell under identical conditions but in the absence of the cytotoxic agent. Toxicity can be quantitated, for example, in cells or in mammals as the amount of an agent needed to induce 50% cell death (i.e., $EC_{50}$ or $ED_{50}$, respectively) or by other methods known in the art.

Assays for indicating cytotoxicity are known in the art, such as cell rounding assays (see, for example, Kuehne et al. Nature. 2010 Oct. 7; 467(7316):711-3). The action of TcdA and TcdB causes cells to round (e.g., lose morphology) and die, and such a phenomenon is visible by light microscopy. See, for example, FIG. 9.

Additional exemplary cytotoxicity assays known in the art include glucosylation assays relating to phosphorimaging of Ras labeled with [$^{14}$C]glucose assays (as described in Busch et al., J Biol. Chem. 1998 Jul. 31; 273(31):19566-72), and preferably the in vitro cytotoxicity assay described in the Examples below wherein $EC_{50}$ may refer to a concentration of an immunogenic composition that exhibits at least about 50% of cytopathogenic effect (CPE) in a cell, preferably a human diploid fibroblast cell (e.g., IMR90 cell (ATCC CCL-186™), as compared to an identical cell under identical conditions in the absence of the toxin. The in vitro cytotoxicity assay may also be used to assess the concentration of a composition that inhibits at least about 50% of a wild-type *C. difficile* toxin-induced cytopathogenic effect (CPE) in a cell, preferably a human diploid fibroblast cell (e.g., IMR90 cell (ATCC CCL-186™), as compared to an identical cell under identical conditions in the absence of the toxin. Additional exemplary cytotoxicity assays include those described in Doern et al., J Clin Microbiol. 1992 August; 30(8):2042-6. Cytotoxicity can also be determined by measuring ATP levels in cells treated with toxin. For example, a luciferase based substrate such as CELLTITERGLO® (Promega) may be used, which emits luminescence measured as a relative light unit (RLU). In such an assay, cell viability may be directly proportional to the amount of ATP in the cells or the RLU values.

In one embodiment, the cytotoxicity of the immunogenic composition is reduced by at least about 1000, 2000, 3000, 4000, 5000-, 6000-, 7000-, 8000-, 9000-, 10000-, 11000-, 12000-, 13000-fold, 14000-fold, 15000-fold, or more, as compared to the corresponding wild-type *C. difficile* toxin. See, for example, Table 20.

In another embodiment, the cytotoxicity of the immunogenic composition is reduced by at least about 2-$\log_{10}$, more preferably by about 3-$\log_{10}$, and most preferably by about 4-$\log_{10}$ or more, relative to the corresponding wild-type toxin under identical conditions. For example, a mutant *C. difficile* TcdB may have an $EC_{50}$ value of about $10^{-9}$ g/ml as measured in a standard cytopathic effect assay (CPE), as compared to an exemplary wild-type *C. difficile* TcdB which may have an $EC_{50}$ value of at least about $10^{-12}$ g/ml. See, for example, Tables 7A, 7B, 8A and 8B in the Examples section below.

In yet another embodiment, the cytotoxicity of the mutant *C. difficile* toxin has an $EC_{50}$ of at least about 50 µg/ml, 100 µg/ml, 200 µg/ml, 300 µg/ml, 400 µg/ml, 500 µg/ml, 600 µg/ml, 700 µg/ml, 800 µg/ml, 900 µg/ml, 1000 µg/ml or greater, as measured by, for example, an in vitro cytotoxicity assay, such as one described herein. Accordingly, in a preferred embodiment, the immunogenic compositions and mutant toxins are biologically safe for administration to mammals.

Without being bound by mechanism or theory, a TcdA having a D285 and D287 mutation, as compared to a wild-type TcdA, and a TcdB having a D286 and a D288 mutation, as compared to a wild-type TcdB, were expected to be defective in glycosyltransferase activity and therefore defective in inducing a cytopathic effect. In addition, a toxin having a mutation in the DHC motif was expected to be defective in autocatalytic processing, and therefore be without any cytotoxic effects.

However, the inventors surprisingly discovered, among other things, that exemplary mutant TcdA having SEQ ID NO: 4 and exemplary mutant TcdB having SEQ ID NO: 6 unexpectedly exhibited cytotoxicity (albeit significantly reduced from wild-type *C. difficile* 630 toxins) despite exhibiting dysfunctional glucosyltransferase activity and dysfunctional cysteine protease activity. Without being bound by mechanism or theory, the mutant toxins are believed to effect cytotoxicity through a novel mechanism. Nevertheless, the exemplary mutant TcdA having SEQ ID NO: 4 and exemplary mutant TcdB having SEQ ID NO: 6 were surprisingly immunogenic. See Examples below.

Although chemical crosslinking of a wild-type toxin has a potential to fail in inactivating the toxin, the inventors further discovered that chemically crosslinking at least one amino acid of a mutant toxin further reduced cytotoxicity of the mutant toxin, relative to an identical mutant toxin lacking chemical crosslinks, and relative to the corresponding wild-type toxin. Preferably, the mutant toxin is purified before contact with the chemical crosslinking agent.

Moreover, despite a potential of chemical crosslinking agents to alter useful epitopes, the inventors surprisingly discovered that a genetically modified mutant *C. difficile* toxin having at least one amino acid chemically crosslinked resulted in immunogenic compositions that elicited multiple neutralizing antibodies or binding fragments thereof. Accordingly, epitopes associated with neutralizing antibody molecules were unexpectedly retained following chemical crosslinking.

Crosslinking (also referred to as "chemical inactivation" or "inactivation" herein) is a process of chemically joining two or more molecules by a covalent bond. The terms "crosslinking reagents," "crosslinking agents," and "crosslinkers" refer to molecules that are capable of reacting with and/or chemically attaching to specific functional groups (primary amines, sulhydryls, carboxyls, carbonyls, etc) on peptides, polypeptides, and/or proteins. In one embodiment, the molecule may contain two or more reactive ends that are capable of reacting with and/or chemically attaching to specific functional groups (primary amines, sulhydryls, carboxyls, carbonyls, etc) on peptides, polypeptides, and/or proteins. Preferably, the chemical crosslinking agent is water-soluble. In another preferred embodiment, the chemical crosslinking agent is a heterobifunctional crosslinker. In another embodiment, the chemical crosslinking agent is not a bifunctional crosslinker. Chemical crosslinking agents are known in the art.

In a preferred embodiment, the crosslinking agent is a zero-length crosslinking agent. A "zero-length" crosslinker refers to a crosslinking agent that will mediate or produce a direct crosslink between functional groups of two molecules. For example, in the crosslinking of two polypeptides, a zero-length crosslinker will result in the formation of a bridge, or a crosslink between a carboxyl group from an amino acid side chain of one polypeptide, and an amino group of another polypeptide, without integrating extrinsic matter. Zero-length crosslinking agents can catalyze, for example, the formation of ester linkages between hydroxyl and carboxyl moieties, and/or the formation of amide bonds between carboxyl and primary amino moieties.

Exemplary suitable chemical crosslinking agents include formaldehyde; formalin; acetaldehyde; propionaldehyde; water-soluble carbodiimides (RN=C=NR'), which include 1-Ethyl-3-(3-Dimethylaminopropyl)-Carbodiimide (EDC), 1-Ethyl-3-(3-Dimethylaminopropyl)-Carbodiimide Hydrochloride, 1-Cyclohexyl-3-(2-morpholinyl-(4-ethyl)carbodiimide metho-p-toluenesulfonate (CMC), N,N'-dicyclohexyl-carbodiimide (DCC), and N,N'-diisopropylcarbodiimide (DIC), and derivatives thereof; and N-hydroxysuccinimide (NHS); phenylglyoxal; and/or UDP-dialdehyde.

Figures 24A, 24B, 24C:
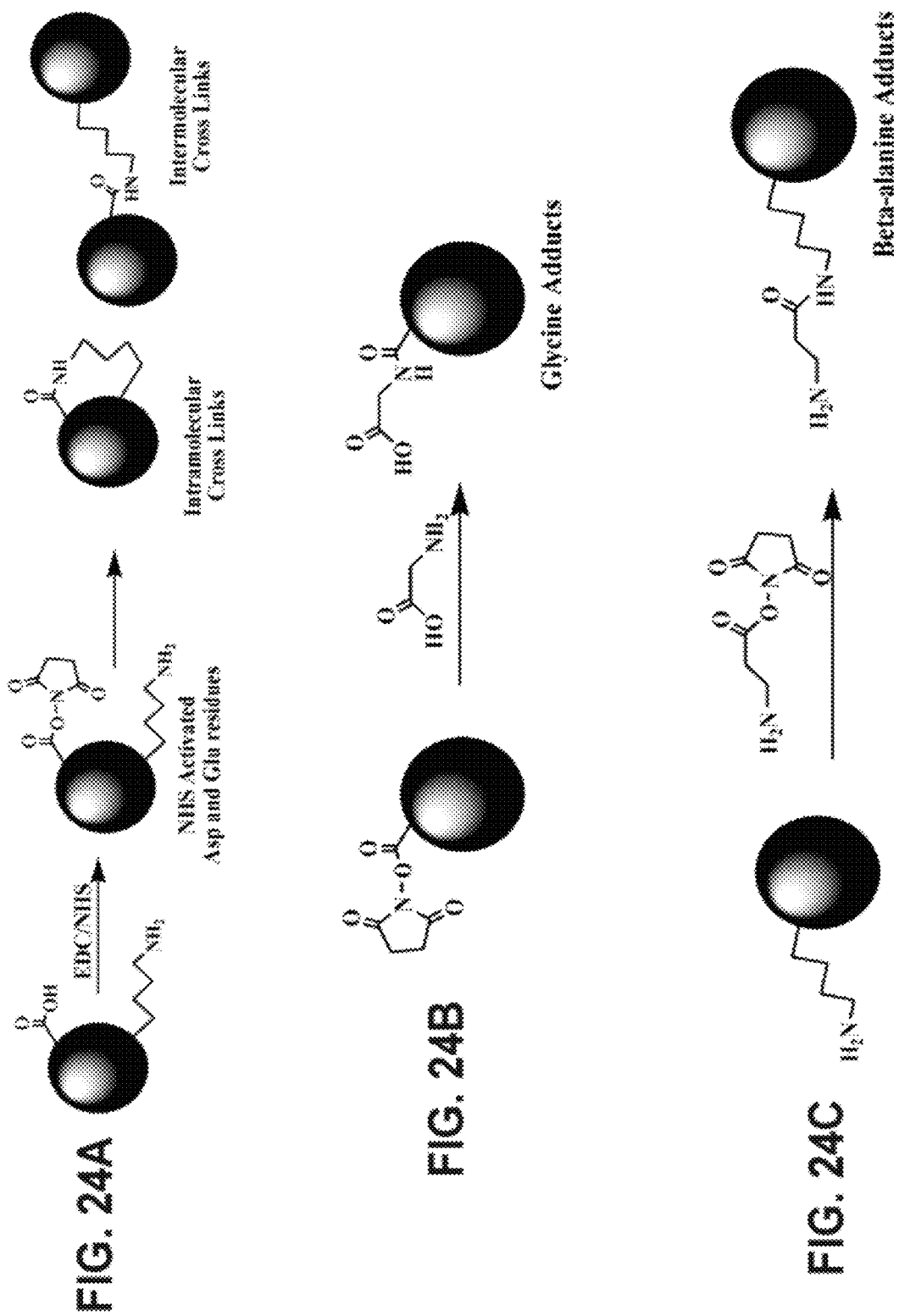
FIG. 24: Illustration of an exemplary EDC/NHS inactivation of mutant C. difficile toxins, resulting in at least three possible types of modifications: crosslinks, glycine adducts, and beta-alanine adducts. Panel A illustrates crosslinking. Carboxylic residues of triple mutant toxins are activated by the addition of EDC and NHS. The activated esters react with primary amines to form stable amide bonds, resulting in intra- and intermolecular crosslinks. Panel B illustrates formation of glycine adducts. After inactivation, residual activated esters are quenched by the addition of glycine to form stable amide bonds. Panel C illustrates formation of beta-alanine adducts. Three moles of NHS can react with one mole of EDC to form activated beta-alanine. This then reacts with primary amines to form stable amide bonds.
Figure 25:
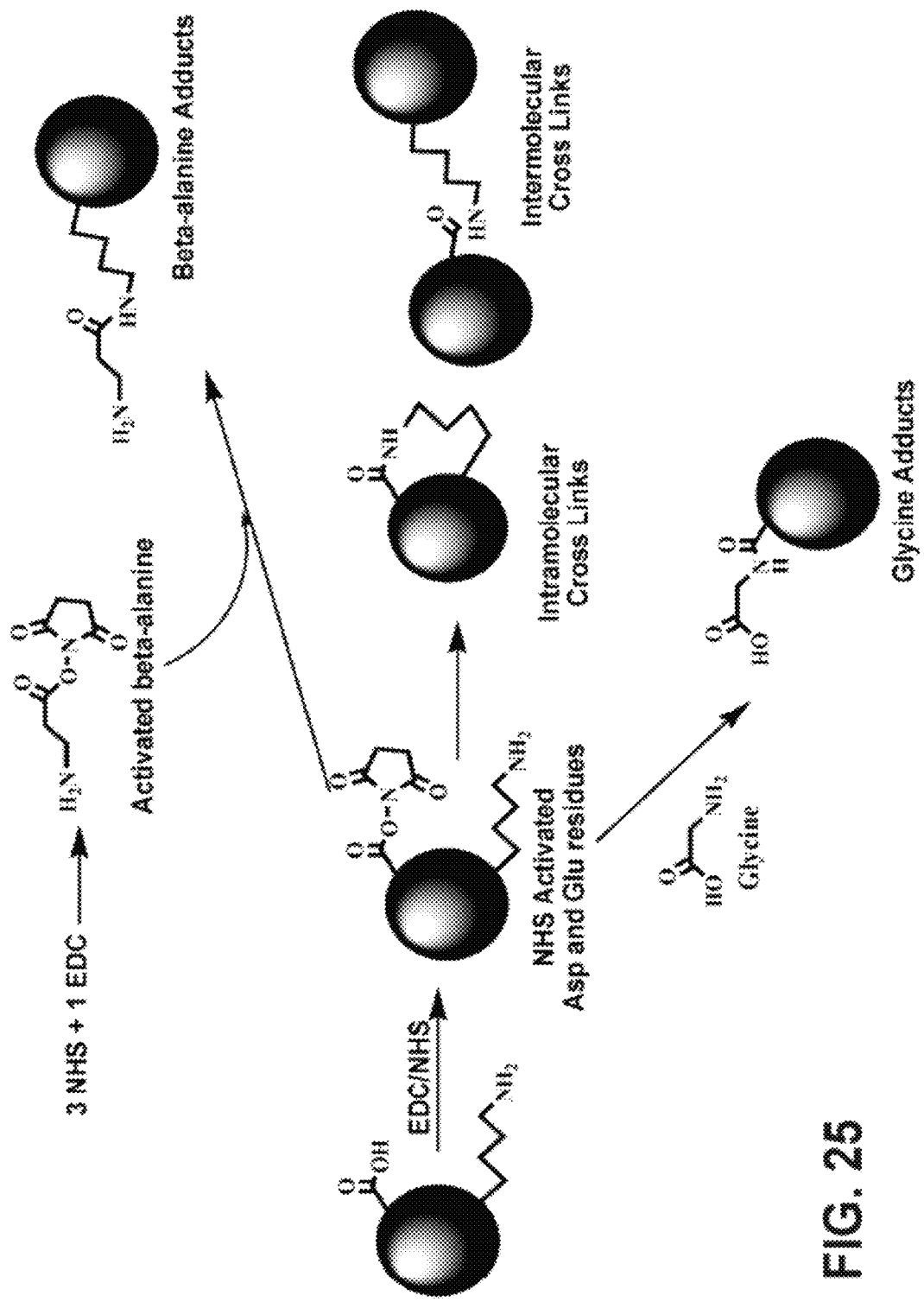
FIG. 25: Illustration of an exemplary EDC/NHS inactivation of mutant C. difficile toxins, resulting in at least one of the following types of modifications: (A) crosslinks, (B) glycine adducts, and (C) beta-alanine adducts.

Preferably, the crosslinking agent is EDC. When a mutant *C. difficile* toxin polypeptide is chemically modified by EDC (e.g., by contacting the polypeptide with EDC), in one embodiment, the polypeptide includes (a) at least one crosslink between a side chain of an aspartic acid residue of the polypeptide and a side chain of a lysine residue of the polypeptide. In one embodiment, the polypeptide includes (b) at least one crosslink between a side chain of a glutamic acid residue of the polypeptide and a side chain of a lysine residue of the polypeptide. In one embodiment, the polypeptide includes (c) at least one crosslink between the carboxyl group at the C-terminus of the polypeptide and the amino group of the N-terminus of the polypeptide. In one embodiment, the polypeptide includes (d) at least one crosslink between the carboxyl group at the C-terminus of the polypeptide and a side chain of a lysine residue of the polypeptide. In one embodiment, the polypeptide includes (e) at least one crosslink between a side chain of an aspartic acid residue of the polypeptide and a side chain of a lysine residue of a second isolated polypeptide. In one embodiment, the polypeptide includes (f) at least one crosslink between a side chain of a glutamic acid residue of the polypeptide and a side chain of a lysine residue of a second isolated polypeptide. In one embodiment, the polypeptide includes (g) at least one crosslink between the carboxyl group at the C-terminus of the polypeptide and the amino group of the N-terminus of a second isolated polypeptide. In one embodiment, the polypeptide includes (h) at least one crosslink between the carboxyl group at the C-terminus of the polypeptide and a side chain of a lysine residue of a second isolated polypeptide. See, for example, FIG. 24 and FIG. 25.

The "second isolated polypeptide" refers to any isolated polypeptide that is present during the reaction with EDC. In one embodiment, the second isolated polypeptide is a mutant *C. difficile* toxin polypeptide having an identical sequence as the first isolated polypeptide. In another embodiment, the second isolated polypeptide is a mutant *C. difficile* toxin polypeptide having a different sequence from the first isolated polypeptide.

In one embodiment, the polypeptide includes at least two modifications selected from the (a)-(d) modifications. In an exemplary embodiment, the polypeptide includes (a) at least one crosslink between a side chain of an aspartic acid residue of the polypeptide and a side chain of a lysine residue of the polypeptide and (b) at least one crosslink between a side chain of a glutamic acid residue of the polypeptide and a side chain of a lysine residue of the polypeptide. In a further embodiment, the polypeptide includes at least three modifications selected from the (a)-(d) modifications. In yet a further embodiment, the polypeptide includes the (a), (b), (c), and (d) modifications.

When more than one mutant polypeptide is present during chemical modification by EDC, in one embodiment, the resulting composition includes at least one of any of the (a)-(h) modifications. In one embodiment, the composition includes at least two modifications selected from the (a)-(h) modifications. In a further embodiment, the composition includes at least three modifications selected from the (a)-(h) modifications. In yet a further embodiment, the composition includes at least four modifications selected from the (a)-(h) modifications. In another embodiment, the composition includes at least one of each of the (a)-(h) modifications.

In an exemplary embodiment, the resulting composition includes (a) at least one crosslink between a side chain of an aspartic acid residue of the polypeptide and a side chain of a lysine residue of the polypeptide; and (b) at least one crosslink between a side chain of a glutamic acid residue of the polypeptide and a side chain of a lysine residue of the polypeptide. In one embodiment, the composition further includes (c) at least one crosslink between the carboxyl group at the C-terminus of the polypeptide and the amino group of the N-terminus of the polypeptide; and (d) at least one crosslink between the carboxyl group at the C-terminus of the polypeptide and a side chain of a lysine residue of the polypeptide.

In another exemplary embodiment, the resulting composition includes (e) at least one crosslink between a side chain of an aspartic acid residue of the polypeptide and a side chain of a lysine residue of a second isolated polypeptide; (f) at least one crosslink between a side chain of a glutamic acid residue of the polypeptide and a side chain of a lysine residue of a second isolated polypeptide; (g) at least one crosslink between the carboxyl group at the C-terminus of the polypeptide and the amino group of the N-terminus of a second isolated polypeptide; and (h) at least one crosslink between the carboxyl group at the C-terminus of the polypeptide and a side chain of a lysine residue of a second isolated polypeptide.

In a further exemplary embodiment, the resulting composition includes (a) at least one crosslink between a side chain of an aspartic acid residue of the polypeptide and a side chain of a lysine residue of the polypeptide; (b) at least one crosslink between a side chain of a glutamic acid residue of the polypeptide and a side chain of a lysine residue of the polypeptide; (e) at least one crosslink between a side chain of an aspartic acid residue of the polypeptide and a side chain of a lysine residue of a second isolated polypeptide; and (f) at least one crosslink between a side chain of a glutamic acid residue of the polypeptide and a side chain of a lysine residue of a second isolated polypeptide.

In a preferred embodiment, the chemical crosslinking agent includes formaldehyde, more preferably, an agent including formaldehyde in the absence of lysine. Glycine or other appropriate compound with a primary amine can be used as the quencher in crosslinking reactions. Accordingly, in another preferred embodiment, the chemical agent includes formaldehyde and use of glycine.

In yet another preferred embodiment, the chemical crosslinking agent includes EDC and NHS. As is known in the art, NHS may be included in EDC coupling protocols. However, the inventors surprisingly discovered that NHS may facilitate in further decreasing cytotoxicity of the mutant C. difficile toxin, as compared to the corresponding wild-type toxin, as compared to a genetically mutated toxin, and as compared to a genetically mutated toxin that has been chemically crosslinked by EDC. See, for example, Example 22. Accordingly, without being bound by mechanism or theory, a mutant toxin polypeptide having a beta-alanine moiety linked to a side chain of at least one lysine residue of the polypeptide (e.g., resulting from a reaction of the mutant toxin polypeptide, EDC, and NHS) may facilitate in further decreasing cytotoxicity of the mutant toxin, as compared to, for example, a C. difficile toxin (wild-type or mutant) wherein a beta-alanine moiety is absent.

Use of EDC and/or NHS may also include use of glycine or other appropriate compound with a primary amine as the quencher. Any compound having a primary amine may be used as a quencher, such as, for example glycine methyl ester and alanine. In a preferred embodiment, the quencher compound is a non-polymeric hydrophilic primary amine. Examples of a non-polymeric hydrophilic primary amine include, for example, amino sugars, amino alcohols, and amino polyols. Specific examples of a non-polymeric hydrophilic primary amine include glycine, ethanolamine, glucamine, amine functionalized polyethylene glycol, and amine functionalized ethylene glycol oligomers.

In one aspect, the invention relates to a mutant C. difficile toxin polypeptide having at least one amino acid side chain chemically modified by EDC and a non-polymeric hydrophilic primary amine, preferably glycine. The resulting glycine adducts (e.g., from a reaction of triple mutant toxins treated with EDC, NHS, and quenched with glycine) may facilitate in decreasing cytotoxicity of the mutant toxin as compared to the corresponding wild-type toxin.

In one embodiment, when a mutant C. difficile toxin polypeptide is chemically modified by EDC and glycine, the polypeptide includes at least one modification when the polypeptide is modified by EDC (e.g., at least one of any of the (a)-(h) modifications described above), and at least one of the following exemplary modifications: (i) a glycine moiety linked to the carboxyl group at the C-terminus of the polypeptide; (j) a glycine moiety linked to a side chain of at least one aspartic acid residue of the polypeptide; and (k) a glycine moiety linked to a side chain of at least one glutamic acid residue of the polypeptide. See, for example, FIG. 24 and FIG. 25.

In one embodiment, at least one amino acid of the mutant C. difficile TcdA is chemically crosslinked and/or at least one amino acid of the mutant C. difficile TcdB is chemically crosslinked. In another embodiment, at least one amino acid of SEQ ID NO: 4, SEQ ID NO: 6, SEQ ID NO: 7, and/or SEQ ID NO: 8 is chemically crosslinked. For example, the at least one amino acid may be chemically crosslinked by an agent that includes a carbodiimide, such as EDC. Carbodiimides may form a covalent bond between free carboxyl (e.g., from the side chains of aspartic acid and/or glutamic acid) and amino groups (e.g., in the side chain of lysine residues) to form stable amide bonds.

As another example, the at least one amino acid may be chemically crosslinked by an agent that includes NHS. NHS ester-activated crosslinkers may react with primary amines (e.g., at the N-terminus of each polypeptide chain and/or in the side chain of lysine residues) to yield an amide bond.

In another embodiment, the at least one amino acid may be chemically crosslinked by an agent that includes EDC and NHS. For example, in one embodiment, the invention relates to an isolated polypeptide having the amino acid sequence set forth in SEQ ID NO: 4, wherein the methionine residue at position 1 is optionally not present, wherein the polypeptide includes at least one amino acid side chain chemically modified by EDC and NHS. In another embodiment, the invention relates to an isolated polypeptide having the amino acid sequence set forth in SEQ ID NO: 6, wherein the methionine residue at position 1 is optionally not present, wherein the polypeptide includes at least one amino acid side chain chemically modified by EDC and NHS. In yet another embodiment, the invention relates to an isolated polypeptide having the amino acid sequence set forth in SEQ ID NO: 84, SEQ ID NO: 86, SEQ ID NO: 83, SEQ ID NO: 85, SEQ ID NO: 7, or SEQ ID NO: 8. The polypeptide is modified by contacting the polypeptide with EDC and NHS. See, for example, FIG. 24 and FIG. 25.

When a mutant C. difficile toxin polypeptide is chemically modified by (e.g., by contacting) EDC and NHS, in one embodiment, the polypeptide includes at least one modification when the polypeptide is modified by EDC (e.g., at least one of any of the (a)-(h) modifications described above), and (l) a beta-alanine moiety linked to a side chain of at least one lysine residue of the polypeptide.

In another aspect, the invention relates to a mutant C. difficile toxin polypeptide wherein the polypeptide includes at least one amino acid side chain chemically modified by EDC, NHS, and a non-polymeric hydrophilic primary amine, preferably glycine. In one embodiment, the polypeptide includes at least one modification when the polypeptide is modified by EDC (e.g., at least one of any of the (a)-(h) modifications described above), at least one modification when the polypeptide is modified by glycine (e.g., at least one of any of the (i)-(k) modifications described above), and (l) a beta-alanine moiety linked to a side chain of at least one lysine residue of the polypeptide. See, for example, FIG. 24 and FIG. 25.

In one aspect, the invention relates to a mutant *C. difficile* toxin polypeptide, wherein a side chain of at least one lysine residue of the polypeptide is linked to a beta-alanine moiety. In one embodiment, a side chain of a second lysine residue of the polypeptide is linked to a side chain of an aspartic acid residue and/or to a side chain of a glutamic acid residue. The "second" lysine residue of the polypeptide includes a lysine residue of the polypeptide that is not linked to a beta-alanine moiety. The side chain of an aspartic acid and/or the side chain of a glutamic acid to which the second lysine residue is linked may be that of the polypeptide to form an intra-molecular crosslink, or that of a second polypeptide to form an inter-molecular crosslink. In another embodiment, a side chain of at least one aspartic acid residue and/or a side chain of at least one glutamic acid residue of the polypeptide is linked to a glycine moiety. The aspartic acid residue and/or the glutamic acid residue that is linked to a glycine moiety is not also linked to a lysine residue.

As yet another example of a chemically crosslinked mutant *C. difficile* toxin polypeptide, the at least one amino acid may be chemically crosslinked by an agent that includes formaldehyde. Formaldehyde may react with the amino group of an N-terminal amino acid residue and the side-chains of arginine, cysteine, histidine, and lysine. Formaldehyde and glycine may form a Schiff-base adduct, which may attach to primary N-terminal amino groups, arginine, and tyrosine residues, and to a lesser degree asparagine, glutamine, histidine, and tryptophan residues.

A chemical crosslinking agent is said to reduce cytotoxicity of a toxin if the treated toxin has less toxicity (e.g., about 100%, 99%, 95%, 90%, 80%, 75%, 60%, 50%, 25%, or 10% less toxicity) than untreated toxin under identical conditions, as measured, for example, by an in vitro cytotoxicity assay, or by animal toxicity.

Preferably, the chemical crosslinking agent reduces cytotoxicity of the mutant *C. difficile* toxin by at least about a 2-$\log_{10}$ reduction, more preferably about a 3-$\log_{10}$ reduction, and most preferably about a 4-$\log_{10}$ or more, relative to the mutant toxin under identical conditions but in the absence of the chemical crosslinking agent. As compared to the wild-type toxin, the chemical crosslinking agent preferably reduces cytotoxicity of the mutant toxin by at least about a 5-$\log_{10}$ reduction, about a 6-$\log_{10}$ reduction, about a 7-$\log_{10}$ reduction, about an 8-$\log_{10}$ reduction, or more.

In another preferred embodiment, the chemically inactivated mutant *C. difficile* toxin exhibits $EC_{50}$ value of greater than or at least about 50 µg/ml, 100 µg/ml, 200 µg/ml, 300 µg/ml, 400 µg/ml, 500 µg/ml, 600 µg/ml, 700 µg/ml, 800 µg/ml, 900 µg/ml, 1000 µg/ml or greater, as measured by, for example, an in vitro cytotoxicity assay, such as one described herein.

Reaction conditions for contacting the mutant toxin with the chemical crosslinking agent are within the scope of expertise of one skilled in the art, and the conditions may vary depending on the agent used. However, the inventors surprisingly discovered optimal reaction conditions for contacting a mutant *C. difficile* toxin polypeptide with a chemical crosslinking agent, while retaining functional epitopes and decreasing cytotoxicity of the mutant toxin, as compared to the corresponding wild-type toxin.

Preferably, the reaction conditions are selected for contacting a mutant toxin with the crosslinking agent, wherein the mutant toxin has a minimum concentration of about 0.5, 0.75, 1.0, 1.25, 1.5, 1.75, 2.0 mg/ml to a maximum of about 3.0, 2.5, 2.0, 1.5, or 1.25 mg/ml. Any minimum value may be combined with any maximum value to define a range of suitable concentrations of a mutant toxin for the reaction. Most preferably, the mutant toxin has a concentration of about 1.0-1.25 mg/ml for the reaction.

In one embodiment, the agent used in the reaction has a minimum concentration of about 1 mM, 2 mM, 3 mM, 4 mM, 5 mM, 10 mM, 15 mM, 20 mM, 30 mM, 40 mM, or 50 mM, and a maximum concentration of about 100 mM, 90 mM, 80 mM, 70 mM, 60 mM, or 50 mM. Any minimum value may be combined with any maximum value to define a range of suitable concentrations of the chemical agent for the reaction.

In a preferred embodiment wherein the agent includes formaldehyde, the concentration used is preferably any concentration between about 2 mM to 80 mM, most preferably about 40 mM. In another preferred embodiment wherein the agent includes EDC, the concentration used is preferably any concentration between about 1.3 mM to about 13 mM, more preferably about 2 mM to 3 mM, most preferably about 2.6 mM.

Exemplary reaction times in which the mutant toxin is contacted with the chemical crosslinking agent include a minimum of about 0.5, 1, 2, 3, 4, 5, 6, 12, 24, 36, 48, or 60 hours, and a maximum of about 14 days, 12 days, 10 days, 7 days, 5 days, 3 days, 2 days, 1 day, or 12 hours. Any minimum value may be combined with any maximum value to define a range of suitable reaction times.

In a preferred embodiment, the step of contacting the mutant toxin with the chemical crosslinking agent occurs for a period of time that is sufficient to reduce cytotoxicity of the mutant *C. difficile* toxin to an $EC_{50}$ value of at least about 1000 µg/ml in a suitable human cell, e.g., IMR-90 cells, in a standard in vitro cytotoxicity assay, as compared to an identical mutant toxin in the absence of the crosslinking agent. More preferably, the reaction step is carried out for a time that is at least twice as long, and most preferably at least three times as long or more, as the period of time sufficient to reduce the cytotoxicity of the mutant toxin to an $EC_{50}$ value of at least about 1000 µg/ml in a suitable human cell. In one embodiment, the reaction time does not exceed about 168 hours (or 7 days).

For example, in one embodiment wherein the agent includes formaldehyde, the mutant toxin is preferably contacted with the agent for about 12 hours, which was shown to be an exemplary period of time that was sufficient to reduce cytotoxicity of the mutant *C. difficile* toxin to an $EC_{50}$ value of at least about 1000 µg/ml in a suitable human cell, e.g., IMR-90 cells, in a standard in vitro cytotoxicity assay, as compared to an identical mutant toxin in the absence of the crosslinking agent. In a more preferred embodiment, the reaction is carried out for about 48 hours, which is at least about three times as long as a sufficient period of time for the reaction. In such an embodiment, the reaction time is preferably not greater than about 72 hours.

In another embodiment wherein the agent includes EDC, the mutant toxin is preferably contacted with the agent for about 0.5 hours, more preferably at least about 1 hour, or most preferably about 2 hours. In such an embodiment, the reaction time is preferably not greater than about 6 hours.

Exemplary pH at which the mutant toxin is contacted with the chemical crosslinking agent include a minimum of about pH 5.5, 6.0, 6.5, 7.0, or 7.5, and a maximum of about pH 8.5, 8.0, 7.5, 7.0, or 6.5. Any minimum value may be combined with any maximum value to define a range of suitable pH. Preferably, the reaction occurs at pH 6.5 to 7.5, preferably at pH 7.0.

Exemplary temperatures at which the mutant toxin is contacted with the chemical crosslinking agent include a minimum of about 2° C., 4° C., 10° C., 20° C., 25° C., or 37° C., and a maximum temperature of about 40° C., 37° C., 30° C., 27° C., 25° C., or 20° C. Any minimum value may be combined with any maximum value to define a range of suitable reaction temperature. Preferably, the reaction occurs at about 20° C. to 30° C., most preferably at about 25° C.

The immunogenic compositions described above may include one mutant *C. difficile* toxin (A or B). Accordingly, the immunogenic compositions can occupy separate vials (e.g., a separate vial for a composition including mutant *C. difficile* toxin A and a separate vial for a composition including mutant *C. difficile* toxin B) in the preparation or kit. The immunogenic compositions may be intended for simultaneous, sequential, or separate use.

In another embodiment, the immunogenic compositions described above may include both mutant *C. difficile* toxins (A and B). Any combination of mutant *C. difficile* toxin A and mutant *C. difficile* toxin B described may be combined for an immunogenic composition. Accordingly, the immunogenic compositions can be combined in a single vial (e.g., a single vial containing both a composition including mutant *C. difficile* TcdA and a composition including mutant *C. difficile* TcdB). Preferably, the immunogenic compositions include a mutant *C. difficile* TcdA and a mutant *C. difficile* TcdB.

For example, in one embodiment, the immunogenic composition includes SEQ ID NO: 4 and SEQ ID NO: 6, wherein at least one amino acid of each of SEQ ID NO: 4 and SEQ ID NO: 6 is chemically crosslinked. In another embodiment, the immunogenic composition includes a mutant *C. difficile* toxin A, which includes SEQ ID NO: 4 or SEQ ID NO: 7, and a mutant *C. difficile* toxin B, which comprises SEQ ID NO: 6 or SEQ ID NO: 8, wherein at least one amino acid of each of the mutant *C. difficile* toxins is chemically crosslinked.

In another embodiment, the immunogenic composition includes any sequence selected from SEQ ID NO: 4, SEQ ID NO: 84, and SEQ ID NO: 83, and any sequence selected from SEQ ID NO: 6, SEQ ID NO: 86, and SEQ ID NO: 85. In another embodiment, the immunogenic composition includes SEQ ID NO: 84 and an immunogenic composition including SEQ ID NO: 86. In another embodiment, the immunogenic composition includes SEQ ID NO: 83 and an immunogenic composition including SEQ ID NO: 85. In another embodiment, the immunogenic composition includes SEQ ID NO: 84, SEQ ID NO: 83, SEQ ID NO: 86, and SEQ ID NO: 85.

It is understood that any of the inventive compositions, for example, immunogenic compositions including a mutant toxin A and/or mutant toxin B, can be combined in different ratios or amounts for therapeutic effect. For example, the mutant *C. difficile* TcdA and mutant *C. difficile* TcdB can be present in a immunogenic composition at a ratio in the range of 0.1:10 to 10:0.1, A:B. In another embodiment, for example, the mutant *C. difficile* TcdB and mutant *C. difficile* TcdA can be present in a immunogenic composition at a ratio in the range of 0.1:10 to 10:0.1, B:A. In one preferred embodiment, the ratio is such that the composition includes a greater total amount of a mutant TcdB than a total amount of mutant TcdA.

In one aspect, an immunogenic composition is capable of binding to a neutralizing antibody or binding fragment thereof. Preferably, the neutralizing antibody or binding fragment thereof is one described herein below. In one exemplary embodiment, an immunogenic composition is capable of binding to an anti-toxin A antibody or binding fragment thereof, wherein the anti-toxin A antibody or binding fragment thereof includes a variable light chain having the amino acid sequence of SEQ ID NO: 36 and a variable heavy chain having the amino acid sequence of SEQ ID NO: 37. For example, the immunogenic composition may include a mutant *C. difficile* TcdA, SEQ ID NO: 4, or SEQ ID NO: 7. As another example, the immunogenic composition may include SEQ ID NO: 84 or SEQ ID NO: 83.

In another exemplary embodiment, an immunogenic composition is capable of binding to an anti-toxin B antibody or binding fragment thereof, wherein the anti-toxin B antibody or binding fragment thereof includes a variable light chain of B8-26 and a variable heavy chain of B8-26. For example, the immunogenic composition may include a mutant *C. difficile* TcdB, SEQ ID NO: 6, or SEQ ID NO: 8. As another example, the immunogenic composition may include SEQ ID NO: 86 or SEQ ID NO: 85.

Recombinant Cell

In another aspect, the invention relates to a recombinant cell or progeny thereof. In one embodiment, the cell or progeny thereof includes a polynucleotide encoding a mutant *C. difficile* TcdA and/or a mutant *C. difficile* TcdB.

In another embodiment, the recombinant cell or progeny thereof includes a nucleic acid sequence that encodes a polypeptide having at least about 90%, 91%, 92%, 93%, 94%, 95%, 96%, 97%, preferably about 98%, more preferably about 99% or most preferably about 100% identity to any of SEQ ID NO: 4, SEQ ID NO: 6, SEQ ID NO: 7, or SEQ ID NO: 8, when optimally aligned, such as by the programs GAP or BESTFIT using default gap weights.

In another embodiment, the recombinant cell or progeny thereof includes a nucleic acid sequence that encodes a polypeptide having at least about 90%, 91%, 92%, 93%, 94%, 95%, 96%, 97%, preferably about 98%, more preferably about 99% or most preferably about 100% identity to any of SEQ ID NO: 84, SEQ ID NO: 86, SEQ ID NO: 83, or SEQ ID NO: 85, when optimally aligned, such as by the programs GAP or BESTFIT using default gap weights.

In an additional embodiment, the recombinant cell or progeny thereof includes nucleic acid sequence having at least about 90%, 91%, 92%, 93%, 94%, 95%, 96%, 97%, preferably about 98%, more preferably about 99% or most preferably about 100% identity to any of SEQ ID NO: 11, SEQ ID NO: 12, SEQ ID NO: 13, SEQ ID NO: 14, SEQ ID NO: 44, SEQ ID NO: 45, SEQ ID NO: 46, or SEQ ID NO: 47, when optimally aligned, such as by the programs GAP or BESTFIT using default gap weights.

The recombinant cell may be derived from any cell useful in the recombinant production of a polypeptide of the present invention, e.g., a prokaryote or a eukaryote. Preferably, the recombinant cell is derived from any cell that is suitable for expressing heterologous nucleic acid sequences greater than about 5000, 6000, preferably about 7000, and more preferably about 8000 nucleotides or more. The prokaryotic host cell may be any gram-negative or gram-positive bacterium. In exemplary embodiments, the prokaryotic host cell lacks an endogenous polynucleotide encoding a toxin and/or spore. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*. For example, the recombinant cell may be derived from a *Pseudomonas fluorescens* cell, as described in US Patent application publication 2010013762, paragraphs [0201]-[0230], which is incorporated herein by reference.

Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Preferably, the cell is derived from a *C. difficile* cell.

The inventors identified strains of wild-type *C. difficile* that lack an endogenous polynucleotide encoding a *C. difficile* toxin. The strains lacking endogenous toxin A and B genes include the following strains, which are available through the American Type Culture Collection (ATCC) (Manassas, Va.): *C. difficile* 1351 (ATCC43593™) *C. difficile* 3232 (ATCC BAA-1801™), *C. difficile* 7322 (ATCC 43601™), *C. difficile* 5036 (ATCC 43603™), *C. difficile* 4811 (ATCC 43602™), and *C. difficile* VPI 11186 (ATCC 700057 ™)

Accordingly, in one embodiment, the recombinant *C. difficile* cell is derived from a strain described herein. Preferably, the recombinant *C. difficile* cell or progeny thereof is derived from the group consisting of *C. difficile* 1351, *C. difficile* 5036, and *C. difficile* VPI 11186. More preferably, the recombinant *C. difficile* cell or progeny thereof is derived from a *C. difficile* VPI 11186 cell.

In a preferred embodiment, the sporulation gene of the recombinant *C. difficile* cell or progeny thereof is inactivated. Spores may be infective, highly resistant, and facilitate the persistence of *C. difficile* in aerobic environments outside of the host. Spores may also contribute to survival of *C. difficile* inside the host during antimicrobial therapy. Accordingly, a *C. difficile* cell lacking a sporulation gene is useful to produce a safe immunogenic composition for administration to mammals. In addition, use of such cells facilitates safety during manufacturing, e.g., safety to protect the facility, future products, and staff.

Examples of sporulation genes for targeted inactivation include, inter alia, spo0A, spoIIE, $\sigma^E$, $\sigma^G$, and $\sigma^K$. Preferably, the spo0A gene is inactivated.

Methods of inactivating a *C. difficile* sporulation gene are known in the art. For example, a sporulation gene may be inactivated by targeted insertion of a selectable marker, such as, an antibiotic resistance marker. See, for example, Heap et al., *J Microbiol Methods*. 2010 January; 80(1):49-55; Heap et al., *J. Microbiol. Methods*, 2007 September; 70(3):452-464; and Underwood et al., *J. Bacteriol.* 2009 December; 191(23): 7296-305. See also, for example, Minton et al., WO2007/148091, entitled, "DNA Molecules and Methods," incorporated herein by reference in its entirety from pages 33-66, or the corresponding US publication US 20110124109 A1, paragraphs [00137]-[0227].

Method of Producing a Mutant *C. difficile* Toxin

In one aspect, the invention relates to a method of producing a mutant *C. difficile* toxin. In one embodiment, the method includes culturing any recombinant cell or progeny thereof described above, under suitable conditions to express a polypeptide.

In another embodiment, the method includes culturing a recombinant cell or progeny thereof under suitable conditions to express a polynucleotide encoding a mutant *C. difficile* toxin, wherein the cell includes the polynucleotide encoding the mutant *C. difficile* toxin, and wherein the mutant includes a glucosyltransferase domain having at least one mutation and a cysteine protease domain having at least one mutation, relative to the corresponding wild-type *Clostridium difficile* toxin. In one embodiment, the cell lacks an endogenous polynucleotide encoding a toxin.

In a further embodiment, the method includes culturing a recombinant *C. difficile* cell or progeny thereof under suitable conditions to express a polynucleotide encoding a mutant *C. difficile* toxin, wherein the cell includes the polynucleotide encoding the mutant *C. difficile* toxin and the cell lacks an endogenous polynucleotide encoding a *C. difficile* toxin.

In another aspect, the invention relates to a method of producing a mutant *C. difficile* toxin. The method includes the steps of: (a) contacting a *C. difficile* cell with a recombinant *Escherichia coli* cell, wherein the *C. difficile* cell lacks an endogenous polynucleotide encoding a *C. difficile* toxin and the *E. coli* cell includes a polynucleotide that encodes a mutant *C. difficile* toxin; (b) culturing the *C. difficile* cell and the *E. coli* cell under suitable conditions for transfer of the polynucleotide from the *E. coli* cell to the *C. difficile* cell; (c) selecting the *C. difficile* cell comprising the polynucleotide encoding the mutant *C. difficile* toxin; (d) culturing the *C. difficile* cell of step (c) under suitable conditions to express the polynucleotide; and (e) isolating the mutant *C. difficile* toxin.

In the inventive method, the recombinant *E. coli* cell includes a heterologous polynucleotide that encodes the mutant *C. difficile* toxin, described herein. The polynucleotide may be DNA or RNA. In one exemplary embodiment, the polynucleotide that encodes the mutant *C. difficile* toxin is codon-optimized for *E. coli* codon usage. Methods for codon-optimizing a polynucleotide are known in the art.

In one embodiment, the polynucleotide includes a nucleic acid sequence that is at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a polynucleotide encoding a mutant *C. difficile* TcdA, as described above. An exemplary polynucleotide encoding a mutant *C. difficile* toxin A includes SEQ ID NO: 11, SEQ ID NO: 12, SEQ ID NO: 44, and SEQ ID NO: 45.

In another embodiment, the polynucleotide includes a nucleic acid sequence that is at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a polynucleotide encoding a mutant *C. difficile* TcdB, as described above. An exemplary polynucleotide encoding a mutant *C. difficile* toxin B includes SEQ ID NO: 13, SEQ ID NO: 14, SEQ ID NO: 46, and SEQ ID NO: 47. In another embodiment, the polynucleotide encodes SEQ ID NO: 83, SEQ ID NO: 84, SEQ ID NO: 85, or SEQ ID NO: 86.

In one embodiment, the *E. coli* cell that includes the heterologous polynucleotide is an *E. coli* cell that stably hosts the heterologous polynucleotide, which encodes the mutant *C. difficile* toxin. Exemplary *E. coli* cells include a cell selected from the group consisting of MAX Efficiency® Stbl2™ *E. coli* Competent Cells (Invitrogen, Carlsbad, Calif.), One Shot® Stbl3™ Chemically Competent *E. coli* (Invitrogen, Carlsbad, Calif.), ElectroMAX™ Stbl4™ *E. coli* Competent Cells (Invitrogen™, and *E. coli* CA434. In a preferred embodiment, the *E. coli* cloning host cell is not DH5α. More preferably, the *E. coli* cloning host cell is a MAX Efficiency® Stbl2™ *E. coli* Competent Cell.

The inventive method further includes a step of culturing the *C. difficile* cell and the *E. coli* cell under suitable conditions for transfer of the polynucleotide from the *E. coli* cell to the *C. difficile* cell, resulting in a recombinant *C. difficile* cell. In a preferred embodiment, the culture conditions are suitable for transfer of the polynucleotide from the *E. coli* cell (the donor cell) into the *C. difficile* cell (the recipient cell), and resulting in a genetically stable inheritance.

Most preferably, the culture conditions are suitable for bacterial conjugation, which are known in the art. "Conjugation" refers to a particular process of transferring a polynucleotide in which a unidirectional transfer of a polynucleotide (e.g., from a bacterial plasmid) occurs from one bacterium cell (i.e., the "donor") to another (i.e., the "recipient"). The conjugation process involves donor cell-to-recipient cell contact. Preferably, the donor *E. coli* cell is an *E. coli* CA434 cell.

Exemplary suitable (conjugation) conditions for transferring of the polynucleotide from the *E. coli* cell to the *C. difficile* cell include growing liquid cultures of *C. difficile* in brain heart infusion broth (BHI; Oxoid) or Schaedlers anaerobic broth (SAB; Oxoid). In another embodiment, solid *C. difficile* cultures may be grown on fresh blood agar (FBA) or BHI agar. Preferably, the *C. difficile* is grown at 37° C. in an anaerobic environment (e.g., 80% $N_2$, 10% $CO_2$, and 10% $H_2$ [vol/vol]). In one embodiment, the suitable condition includes growing the *E. coli* aerobically in Luria-Bertani (LB) broth or on LB agar at 37° C. For conjugative transfer to *C. difficile*, an exemplary suitable condition includes growing *E. coli* anaerobically on FBA. Antibiotics may be included in the liquid and solid media as is known in the art. Examples of such antibiotics include cycloserine (250 µg/ml), cefoxitin (8 µg/ml), chloramphenicol (12.5 µg/ml), thiamphenicol (15 µg/ml), and erythromycin (5 µg/ml).

The inventive method additionally includes a step of selecting the resulting recombinant *C. difficile* cell that includes the polynucleotide encoding the mutant *C. difficile* toxin. In an exemplary embodiment, the recombinant *C. difficile* cell is a recipient of the polynucleotide encoding the mutant *C. difficile* toxin from the recombinant *E. coli* cell via conjugation.

The inventive method includes a step of culturing the recombinant cell or progeny thereof under suitable conditions to express the polynucleotide encoding the mutant *C. difficile* toxin, resulting in production of a mutant *C. difficile* toxin. Suitable conditions for a recombinant cell to express the polynucleotide include culture conditions suitable for growing a *C. difficile* cell, which are known in the art. For example, suitable conditions may include culturing the *C. difficile* transformants in brain heart infusion broth (BHI; Oxoid) or Schaedlers anaerobic broth (SAB; Oxoid). In another embodiment, solid *C. difficile* cultures may be grown on FBA or BHI agar. Preferably, the *C. difficile* is grown at 37° C. in an anaerobic environment (e.g., 80% $N_2$, 10% $CO_2$, and 10% $H_2$ [vol/vol]).

In one embodiment, the inventive method includes a step of isolating the resulting mutant *C. difficile* toxin. Methods of isolating a protein from *C. difficile* are known in the art.

In another embodiment, the method includes a step of purifying the resulting mutant *C. difficile* toxin. Methods of purifying a polypeptide, such as chromatography, are known in the art.

In an exemplary embodiment, the method further includes a step of contacting the isolated mutant *Clostridium difficile* toxin with a chemical crosslinking agent described above. Preferably, the agent includes formaldehyde, ethyl-3-(3-dimethylaminopropyl) carbodiimide, or a combination of EDC and NHS. Exemplary reaction conditions are described above and in the Examples section below.

In another aspect, the invention relates to an immunogenic composition including a mutant *C. difficile* toxin described herein, produced by any method, preferably by any of the methods described above.

Antibodies

Surprisingly, the inventive immunogenic compositions described above elicited novel antibodies in vivo, suggesting that the immunogenic compositions include a preserved native structure (e.g., a preserved antigenic epitope) of the respective wild-type *C. difficile* toxin and that the immunogenic compositions include an epitope. The antibodies produced against a toxin from one strain of *C. difficile* may be capable of binding to a corresponding toxin produced by another strain of *C. difficile*. That is, the antibodies and binding fragments thereof may by "cross-reactive," which refers to the ability to react with similar antigenic sites on toxins produced from multiple *C. difficile* strains. Cross-reactivity also includes the ability of an antibody to react with or bind an antigen that did not stimulate its production, i.e., the reaction between an antigen and an antibody that was generated against a different but similar antigen.

In one aspect, the inventors surprisingly discovered monoclonal antibodies having a neutralizing effect on *C. difficile* toxins, and methods of producing the same. The inventive antibodies can neutralize *C. difficile* toxin cytotoxicity in vitro, inhibit binding of *C. difficile* toxin to mammalian cells, and/or can neutralize *C. difficile* toxin enterotoxicity in vivo. The present invention also relates to isolated polynucleotides that include nucleic acid sequences encoding any of the foregoing. In addition, the present invention relates to use of any of the foregoing compositions to treat, prevent, decrease the risk of, decrease severity of, decrease occurrences of, and/or delay the outset of a *C. difficile* infection, *C. difficile* associated disease, syndrome, condition, symptom, and/or complication thereof in a mammal, as compared to a mammal to which the composition is not administered, as well as methods for preparing said compositions.

The inventors further discovered that a combination of at least two of the neutralizing monoclonal antibodies can exhibit an unexpectedly synergistic effect in respective neutralization of TcdA or TcdB. Anti-toxin antibodies or binding fragments thereof can be useful in the inhibition of a *C. difficile* infection.

An "antibody" is a protein including at least one or two heavy (H) chain variable regions (abbreviated herein as VH), and at least one or two light (L) chain variable regions (abbreviated herein as VL). The VH and VL regions can be further subdivided into regions of hypervariability, termed "complementarity determining regions" ("CDR"), interspersed with regions that are more conserved, termed "framework regions" (FR). The extent of the framework region and CDRs has been precisely defined (see, Kabat, E. A., et al. *Sequences of Proteins of Immunological Interest*, Fifth Edition, U.S. Department of Health and Human Services, NIH Publication No. 91-3242, 1991, and Chothia, C. et al., *J. Mol. Biol.* 196:901-917, 1987). The term "antibody" includes intact immunoglobulins of types IgA, IgG, IgE, IgD, IgM (as well as subtypes thereof), wherein the light chains of the immunoglobulin may be of types kappa or lambda.

The antibody molecules can be full-length (e.g., an IgG1 or IgG4 antibody). The antibodies can be of the various isotypes, including: IgG (e.g., IgG1, IgG2, IgG3, IgG4), IgM, IgA1, IgA2, IgD, or IgE. In one preferred embodiment, the antibody is an IgG isotype, e.g., IgG1. In another preferred embodiment, the antibody is an IgE antibody.

In another embodiment, the antibody molecule includes an "antigen-binding fragment" or "binding fragment," as used herein, which refers to a portion of an antibody that specifically binds to a toxin of *C. difficile* (e.g., toxin A). The binding fragment is, for example, a molecule in which one or more immunoglobulin chains is not full length, but which specifically binds to a toxin.

Examples of binding portions encompassed within the term "binding fragment" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., *Nature* 341:544-546, 1989), which consists of a VH domain; and (vi) an isolated complementarity determining region (CDR) having sufficient framework to specifically bind, e.g., an antigen binding portion of a variable region.

A binding fragment of a light chain variable region and a binding fragment of a heavy chain variable region, e.g., the two domains of the Fv fragment, VL and VH, can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) *Proc. Natl. Acad. Sci. USA* 85:5879-5883). Such single chain antibodies are also encompassed within the term "binding fragment" of an antibody. These antibody portions are obtained using techniques known in the art, and the portions are screened for utility in the same manner as are intact antibodies.

As used herein, an antibody that "specifically binds" to or is "specific" for a particular polypeptide or an epitope on a particular polypeptide is an antibody that binds to that particular polypeptide or epitope on a particular polypeptide without substantially binding to any other polypeptide or polypeptide epitope. For example, when referring to a biomolecule (e.g., protein, nucleic acid, antibody, etc.) that "specifically binds" to a target, the biomolecule binds to its target molecule and does not bind in a significant amount to other molecules in a heterogeneous population of molecules that include the target, as measured under designated conditions (e.g. immunoassay conditions in the case of an antibody). The binding reaction between the antibody and its target is determinative of the presence of the target in the heterogeneous population of molecules. For example, "specific binding" or "specifically binds" refers to the ability of an antibody or binding fragment thereof to bind to a wild-type and/or mutant toxin of *C. difficile* with an affinity that is at least two-fold greater than its affinity for a non-specific antigen.

In an exemplary embodiment, the antibody is a chimeric antibody. A chimeric antibody can be produced by recombinant DNA techniques known in the art. For example, a gene encoding the Fc constant region of a murine (or other species) monoclonal antibody molecule can be digested with restriction enzymes to remove the region encoding the murine Fc, and the equivalent portion of a gene encoding a human Fc constant region is substituted. A chimeric antibody can also be created by recombinant DNA techniques where DNA encoding murine variable regions can be ligated to DNA encoding the human constant regions.

In another exemplary embodiment, the antibody or binding fragment thereof is humanized by methods known in the art. For example, once murine antibodies are obtained, a CDR of the antibody may be replaced with at least a portion of a human CDR. Humanized antibodies can also be generated by replacing sequences of the murine Fv variable region that are not directly involved in antigen binding with equivalent sequences from human Fv variable regions. General methods for generating humanized antibodies are known in the art.

For example, monoclonal antibodies directed toward *C. difficile* TcdA or *C. difficile* TcdB can also be produced by standard techniques, such as a hybridoma technique (see, e.g., Kohler and Milstein, 1975, *Nature*, 256: 495-497). Briefly, an immortal cell line is fused to a lymphocyte from a mammal immunized with *C. difficile* TcdA, *C. difficile* TcdB, or a mutant *C. difficile* toxin described herein, and the culture supernatants of the resulting hybridoma cells are screened to identify a hybridoma producing a monoclonal antibody that binds to *C. difficile* TcdA or *C. difficile* TcdB. Typically, the immortal cell line is derived from the same mammalian species as the lymphocytes. Hybridoma cells producing a monoclonal antibody of the invention are detected by screening the hybridoma culture supernatants for antibodies that bind *C. difficile* TcdA or *C. difficile* TcdB using an assay, such as ELISA. Human hybridomas can be prepared in a similar way.

As an alternative to producing antibodies by immunization and selection, antibodies of the invention may also be identified by screening a recombinant combinatorial immunoglobulin library with a *C. difficile* TcdA, *C. difficile* TcdB, or a mutant *C. difficile* toxin described herein. The recombinant antibody library may be an scFv library or an Fab library, for example. Moreover, the inventive antibodies described herein may be used in competitive binding studies to identify additional anti-TcdA or anti-TcdB antibodies and binding fragments thereof. For example, additional anti-TcdA or anti-TcdB antibodies and binding fragments thereof may be identified by screening a human antibody library and identifying molecules within the library that competes with the inventive antibodies described herein in a competitive binding assay.

In addition, antibodies encompassed by the present invention include recombinant antibodies that may be generated by using phage display methods known in the art. In phage display methods, phage can be used to display antigen binding domains expressed from a repertoire or antibody library (e.g., human or murine). Phage expressing an antigen binding domain that binds to an immunogen described herein (e.g., a mutant *C. difficile* toxin) can be selected or identified with antigen, e.g., using labeled antigen.

Also within the scope of the invention are antibodies and binding fragments thereof in which specific amino acids have been substituted, deleted, or added. In particular, preferred antibodies have amino acid substitutions in the framework region, such as to improve binding to the antigen. For example, a selected, small number of acceptor framework residues of the immunoglobulin chain can be replaced by the corresponding donor amino acids. Preferred locations of the substitutions include amino acid residues adjacent to the CDR, or which are capable of interacting with a CDR. Criteria for selecting amino acids from the donor are described in U.S. Pat. No. 5,585,089 (e.g., columns 12-16). The acceptor framework can be a mature human antibody framework sequence or a consensus sequence.

As used herein, a "neutralizing antibody or binding fragment thereof" refers to a respective antibody or binding fragment thereof that binds to a pathogen (e.g., a *C. difficile* TcdA or TcdB) and reduces the infectivity and/or an activity of the pathogen (e.g., reduces cytotoxicity) in a mammal and/or in cell culture, as compared to the pathogen under identical conditions in the absence of the neutralizing antibody or binding fragment thereof. In one embodiment, the neutralizing antibody or binding fragment thereof is capable of neutralizing at least about 70%, 75%, 80%, 85%, 90%, 95%, 99%, or more of a biological activity of the pathogen, as compared to the biological activity of the pathogen under identical conditions in the absence of the neutralizing antibody or binding fragment thereof.

As used herein, the term "anti-toxin antibody or binding fragment thereof" refers to an antibody or binding fragment thereof that binds to the respective *C. difficile* toxin (e.g., a *C. difficile* toxin A or toxin B). For example, an anti-toxin A antibody or binding fragment thereof refers to an antibody or binding fragment thereof that binds to TcdA.

The antibodies or binding fragments thereof described herein may be raised in any mammal, wild-type and/or transgenic, including, for example, mice, humans, rabbits, and goats.

When an immunogenic composition described above is one that has been previously administered to a population, such as for vaccination, the antibody response generated in the subjects can be used to neutralize toxins from the same strain and from a strain that did not stimulate production of the antibody. See, for example, Example 37, which shows studies relating to cross-reactivity, generated by the immunogenic composition, between the 630 strain and toxins from various wild-type *C. difficile* strains.

In one aspect, the invention relates to an antibody or binding fragment thereof specific to *C. difficile* TcdA. Monoclonal antibodies that specifically bind to TcdA include A65-33; A60-22; A80-29 and/or, preferably, A3-25.

In one aspect, the invention relates to an antibody or binding fragment thereof specific to a TcdA from any wild type *C. difficile* strain, such as those described above, e.g., to SEQ ID NO: 1. In another aspect, the invention relates to an antibody or binding fragment thereof specific to an immunogenic composition described above. For example, in one embodiment, the antibody or binding fragment thereof is specific to an immunogenic composition that includes SEQ ID NO: 4 or SEQ ID NO: 7. In another embodiment, the antibody or binding fragment thereof is specific to an immunogenic composition that includes SEQ ID NO: 4 or SEQ ID NO: 7, wherein at least one amino acid of SEQ ID NO: 4 or SEQ ID NO: 7 is crosslinked by formaldehyde, EDC, NHS, or a combination of EDC and NHS. In another embodiment, the antibody or binding fragment thereof is specific to an immunogenic composition that includes SEQ ID NO: 84 or SEQ ID NO: 83.

Antibodies or binding fragments thereof having a variable heavy chain and variable light chain regions that are at least about 90%, 91%, 92%, 93%, 94%, 95%, 96%, 97%, preferably about 98%, more preferably about 99% or most preferably about 100% identity to the variable heavy and light chain regions of A65-33; A60-22; A80-29 and/or, preferably, A3-25 can also bind to TcdA.

In one embodiment, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of A3-25 as set forth in SEQ ID NO: 37.

In another embodiment, the antibody or antigen binding fragment thereof includes a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of A3-25 as set forth in SEQ ID NO: 36.

In yet a further aspect, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence set forth in SEQ ID NO: 37, and a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence set forth in SEQ ID NO: 36.

In another embodiment, antibodies or binding fragments thereof having complementarity determining regions (CDRs) of variable heavy chains and/or variable light chains of A65-33; A60-22; A80-29 and/or, preferably, A3-25 can also bind to TcdA.

The CDRs of the variable heavy chain region of A3-25 are shown in Table 4, below.

TABLE 4

Variable Heavy Chain CDR Amino Acid Sequences

| Clone | Chain | CDR | Amino Acid Sequence | SEQ ID NO: |
|---|---|---|---|---|
| A3-25 | Heavy | CDR1 | GFTFTNYWMN | 41 |
| | | CDR2 | EIRLKSHNYATHFAESVKG | 42 |
| | | CDR3 | DYYGNPAFVY | 43 |

The CDRs of the variable light chain region of A3-25 are shown in Table 5, below.

TABLE 5

Variable Light Chain CDR Amino Acid Sequences

| Clone | Chain | CDR | Amino Acid Sequence | SEQ ID NO: |
|---|---|---|---|---|
| A3-25 | Light | CDR1 | RSSQSLIHSNGNTYLH | 38 |
| | | CDR2 | KVSNRFS | 39 |
| | | CDR3 | SQTTYFPYT | 40 |

In one embodiment, the antibody or binding fragment thereof includes amino acid sequences of the heavy chain complementarity determining regions (CDRs) as shown in SEQ ID NOs: 41 (CDR H1), 42 (CDR H2) and 43 (CDR H3), and/or the amino acid sequences of the light chain CDRs as shown in SEQ ID NOs: 38 (CDR L1), 39 (CDR L2) and 40 (CDR L3).

In one exemplary embodiment, the antibody or binding fragment thereof specific to *C. difficile* toxin A specifically binds to an epitope within the N-terminal region of TcdA e.g., an epitope between amino acids 1-1256 of a TcdA, according to the numbering of SEQ ID NO: 1.

In a preferred embodiment, the antibody or binding fragment thereof specific to *C. difficile* toxin A specifically binds to an epitope within the C-terminal region of toxin A, e.g., an epitope between amino acids 1832 to 2710 of a TcdA, according to the numbering of SEQ ID NO: 1. Examples include A3-25; A65-33; A60-22; A80-29.

In yet another embodiment, the antibody or binding fragment thereof specific to *C. difficile* toxin A specifically binds to an epitope within the "translocation" region of *C. difficile* toxin A, e.g., an epitope that preferably includes residues 956-1128 of a TcdA, according to the numbering of SEQ ID NO: 1, such as an epitope between amino acids 659-1832 of a TcdA, according to the numbering of SEQ ID NO: 1.

In another aspect, the invention relates to an antibody or binding fragment thereof specific to *C. difficile* TcdB. For example, the antibody or binding fragment thereof may be specific to a TcdB from any wild type *C. difficile* strain, such as those described above, e.g., to SEQ ID NO: 2. In another aspect, the invention relates to an antibody or binding fragment thereof specific to an immunogenic composition described above. For example, in one embodiment, the antibody or binding fragment thereof is specific to an immunogenic composition that includes SEQ ID NO: 6 or SEQ ID NO: 8.

In another embodiment, the antibody or binding fragment thereof is specific to an immunogenic composition that includes SEQ ID NO: 6 or SEQ ID NO: 8, wherein at least one amino acid of SEQ ID NO: 6 or SEQ ID NO: 8 is crosslinked by formaldehyde, EDC, NHS, or a combination of EDC and NHS. In another embodiment, the antibody or binding fragment thereof is specific to an immunogenic composition that includes SEQ ID NO: 86 or SEQ ID NO: 85.

Monoclonal antibodies that specifically bind to TcdB include antibodies produced by the B2-31; B5-40, B70-2; B6-30; B9-30; B59-3; B60-2; B56-6; and/or, preferably, B8-26 clones described herein.

Antibodies or binding fragments thereof that can also bind to TcdB include those having a variable heavy chain and variable light chain regions that are at least about 90%, 91%, 92%, 93%, 94%, 95%, 96%, 97%, preferably about 98%, more preferably about 99% or most preferably about 100% identity to the variable heavy and light chain regions of B2-31; B5-40, B70-2; B6-30; B9-30; B59-3; B60-2; B56-6, preferably B8-26, B59-3, and/or B9-30.

In one embodiment, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of A3-25 as set forth in SEQ ID NO: 49.

In one embodiment, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of A3-25 as set forth in SEQ ID NO: 60.

In one embodiment, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of A3-25 as set forth in SEQ ID NO: 71.

In another embodiment, the antibody or antigen binding fragment thereof includes a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of A3-25 as set forth in SEQ ID NO: 55.

In another embodiment, the antibody or antigen binding fragment thereof includes a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of A3-25 as set forth in SEQ ID NO: 66.

In another embodiment, the antibody or antigen binding fragment thereof includes a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of A3-25 as set forth in SEQ ID NO: 77.

The amino acid sequence for the variable heavy chain of a neutralizing antibody of *C. difficile* TcdB (B8-26 mAb) is set forth in SEQ ID NO: 49. See Table 25-a.

TABLE 25-a

Variable Heavy Chain Amino Acid Sequences

| Clone | Region | Amino Acid Sequence | SEQ ID NO: |
|---|---|---|---|
| B8-26 | Signal peptide | MGWSCIILFLVATATGVHS | 50 |
|  | Variable heavy chain | QVQLQQPGAELVKPGA PVKLSCKAS GYSFTSYWMN WVKQRPGRGLEWIG RIDPSNSEIYYNQKF KDKATLTVDKSSSTAYIQLSSL TSEDSAVYYCAS GHYGSIFAY WGQGTTLTVSS | 49 |
|  | CDR1 | GYSFTSYWMN | 51 |
|  | CDR2 | RIDPSNSEIYYNQKF | 52 |
|  | CDR3 | GHYGSIFAY | 53 |
|  | Constant region (IgG1) | AKTTPPSVYPLAPGNSK | 54 |

The amino acid sequence for the variable light chain of a neutralizing antibody of *C. difficile* TcdB (B8-26 mAb) is set forth in SEQ ID NO: 55. See Table 25-b.

TABLE 25-b

Variable Light (κ) Chain Amino Acid Sequences

| Clone | Region | Amino Acid Sequence | SEQ ID NO: |
|---|---|---|---|
| B8-26 | Signal peptide | MRFQVQVLGLLLLWISGAQCD | 56 |
|  | Variable light chain | VQITQSPSYLAASPGETITINC RASKSISKYLA WYQEKPGKTNKLLLY SGSTLQS GIPS RFSGSRSGTDFTLIISSLEPEDSAMYYC QQHNEYPLT FGAGTKLELKRADAAPTVSIFPPSSEEFQ | 55 |
|  | CDR1 | RASKSISKYLA | 57 |
|  | CDR2 | SGSTLQS | 58 |
|  | CDR3 | QQHNEYPLT | 59 |

In one embodiment, the antibody or binding fragment thereof includes amino acid sequences of the heavy chain CDRs as shown in SEQ ID NOs: 51 (CDR H1), 52 (CDR H2) and 53 (CDR H3), and/or the amino acid sequences of the light chain CDRs as shown in SEQ ID NOs: 57 (CDR L1), 58 (CDR L2) and 59 (CDR L3).

The amino acid sequence for the variable heavy chain of a neutralizing antibody of *C. difficile* TcdB (B59-3 mAb) is set forth in SEQ ID NO: 60. See Table 26-a.

TABLE 26-a

Variable Heavy Chain Amino Acid Sequences

| Clone | Region | Amino Acid Sequence | SEQ ID NO: |
|---|---|---|---|
| B59-3 | Signal peptide | MGWSYIILFLVATATDVHS | 61 |
|  | Variable heavy chain | QVQLQQPGAELVKPGASVKLS CKAS GYTFTSYWMH | 60 |

TABLE 26-a-continued

Variable Heavy Chain Amino Acid Sequences

| Clone | Region | Amino Acid Sequence | SEQ ID NO: |
|---|---|---|---|
| | | WVKQRPGQGLEWIG VINPSNGRSTYSEKF KTTATVTVDKSSSTAYMQL SILTSEDSAVYYCAR AYYSTSYYAMDY WGQGTSVTVSS | |
| | CDR1 | GYTFTSYWMH | 62 |
| | CDR2 | VINPSNGRSTYSEKF | 63 |
| | CDR3 | AYYSTSYYAMDY | 64 |
| | Constant region (IgG1) | AKTTPPSVYPLAPGNSK | 65 |

The amino acid sequence for the variable light chain of a neutralizing antibody of *C. difficile* TcdB (B59-3 mAb) is set forth in SEQ ID NO: 66. See Table 26-b.

TABLE 26-b

Variable Light (κ) Chain Amino Acid Sequences

| Clone | Region | Amino Acid Sequence | SEQ ID NO: |
|---|---|---|---|
| B59-3 | Signal peptide | MKLPVRLLVLMFWIPASSSD | 67 |
| | Variable light chain | VLMTQSPLSLPVSLGDQASIS C RSSQNIVHSNGNTYLE WYLQKPGQSPKLLIY KVSNRFS GVPDRFSGSGSGTYFTLKISRVEAEDLGVYYC FQGSHFPFT FGTGTKLEIKRADAAPTVSIFPPSSEEFQ | 66 |
| | CDR1 | RSSQNIVHSNGNTYLE | 68 |
| | CDR2 | KVSNRFS | 69 |
| | CDR3 | FQGSHFPFT | 70 |

In one embodiment, the antibody or binding fragment thereof includes amino acid sequences of the heavy chain CDRs as shown in SEQ ID NOs: 62 (CDR H1), 63 (CDR H2) and 64 (CDR H3), and/or the amino acid sequences of the light chain CDRs as shown in SEQ ID NOs: 68 (CDR L1), 69 (CDR L2) and 70 (CDR L3).

The amino acid sequence for the variable heavy chain of a neutralizing antibody of *C. difficile* TcdB (B9-30 mAb) is set forth in SEQ ID NO: 71. See Table 27-a.

TABLE 27-a

Variable Heavy Chain Amino Acid Sequences

| Clone | Region | Amino Acid Sequence | SEQ ID NO: |
|---|---|---|---|
| B9-30 | Signal peptide | MGWSCIILFLVATATGVHS | 72 |
| | Variable heavy chain | QVQLQQPGAEVVKPGAPVKLS CKAS GYPFTNYWMN WVKQRPGRGLEWIG RIDPSNSEIYYNQKF KDKATLTVDKSSSTAYIQLSSLTSEDSAVYY CAS GHYGSIFAY WGQGTTLTVSS | 71 |
| | CDR1 | GYPFTNYWMN | 73 |
| | CDR2 | RIDPSNSEIYYNQKF | 74 |
| | CDR3 | GHYGSIFAY | 75 |
| | Constant region (IgG1) | AKTTPPSVYPLAPGNSK | 76 |

The amino acid sequence for the variable light chain of a neutralizing antibody of *C. difficile* TcdB (B9-30 mAb) is set forth in SEQ ID NO: 77. See Table 27-b.

TABLE 27-b

Variable Light (κ) Chain Amino Acid Sequences

| Clone | Region | Amino Acid Sequence | SEQ ID NO: |
|---|---|---|---|
| B9-30 | Signal peptide | MRFQVQVLGLLLLWISGAQCD | 78 |
| | Variable light chain | VQITQSPSYLAASPGETITINC RASKSISKYLA WYQEKPGKTNKLLIY SGSTLQS GIPS RFSGSRSGTDFTLIISSLEPEDSAMYYC QQHNEYPLT FGAGTKLELKRADAAPTVSIFPPSSEE FQ | 77 |
| | CDR1 | RASKSISKYLA | 79 |
| | CDR2 | SGSTLQS | 80 |
| | CDR3 | QQHNEYPLT | 81 |

In one embodiment, the antibody or binding fragment thereof includes amino acid sequences of the heavy chain CDRs as shown in SEQ ID NOs: 73 (CDR H1), 74 (CDR H2) and 75 (CDR H3), and/or the amino acid sequences of the light chain CDRs as shown in SEQ ID NOs: 79 (CDR L1), 80 (CDR L2) and 81 (CDR L3).

In one aspect, the invention relates to an antibody or binding fragment thereof specific to a wild type *C. difficile* TcdB from any *C. difficile* strain, such as those described above, e.g., to SEQ ID NO: 2. In another aspect, the invention relates to an antibody or binding fragment thereof specific to an immunogenic composition described above. For example, in one embodiment, the antibody or binding fragment thereof is specific to an immunogenic composition that includes SEQ ID NO: 6 or SEQ ID NO: 8. In another embodiment, the antibody or binding fragment thereof is specific to an immunogenic composition that includes SEQ ID NO: 6 or SEQ ID NO: 8, wherein at least one amino acid of SEQ ID NO: 6 or SEQ ID NO: 8 is crosslinked by formaldehyde, EDC, NHS, or a combination of EDC and NHS.

Antibodies or binding fragments thereof having a variable heavy chain and variable light chain regions that are at least about 90%, 91%, 92%, 93%, 94%, 95%, 96%, 97%, preferably about 98%, more preferably about 99% or most preferably about 100% identity to the variable heavy and light chain regions of B2-31; B5-40, B70-2; B6-30; B9-30; B59-3; B60-2; B56-6; and/or, preferably, B8-26 can also bind to TcdB.

In one embodiment, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of B8-26 (SEQ ID NO: 49).

In another embodiment, the antibody or antigen binding fragment thereof includes a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of B8-26 (SEQ ID NO: 55).

In yet a further aspect, the antibody or antigen binding fragment thereof includes a variable heavy chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable heavy chain region amino acid sequence of B8-26 (SEQ ID NO: 49), and a variable light chain region including an amino acid sequence at least about 60%, 65%, 70%, 75%, 80%, 85%, 86%, 87%, 88%, 89%, 90%, 91%, 92%, 93%, 94%, 95%, 96%, 97%, 98%, 99%, or 100% identical to a variable light chain region amino acid sequence of B8-26 (SEQ ID NO: 55).

In another embodiment, antibodies or binding fragments thereof having CDRs of variable heavy chains and/or variable light chains of B2-31; B5-40, B70-2; B6-30; B9-30; B59-3; B60-2; B56-6; and/or, preferably, B8-26 can also bind to TcdB.

In one embodiment, the antibody or binding fragment thereof includes amino acid sequences of the heavy chain complementarity determining regions (CDRs) of B8-26, and/or the amino acid sequences of the light chain CDRs of B8-26.

In a preferred embodiment, the antibody or binding fragment thereof specific to *C. difficile* toxin B specifically binds to an epitope within the N-terminal region of toxin B, e.g., an epitope between amino acids 1-1256 of a TcdB, according to the numbering of SEQ ID NO: 2. Examples include B2-31; B5-40; B8-26; B70-2; B6-30; and B9-30.

In an exemplary embodiment, the antibody or binding fragment thereof specific to *C. difficile* toxin B specifically binds to an epitope within the C-terminal region of toxin B, e.g., an epitope between amino acids 1832 to 2710 of a TcdB, according to the numbering of SEQ ID NO: 2.

In yet another embodiment, the antibody or binding fragment thereof specific to *C. difficile* toxin B specifically binds to an epitope within the "translocation" region of *C. difficile* toxin B, e.g., an epitope that preferably includes residues 956-1128 of a TcdB, according to the numbering of SEQ ID NO: 2, such as an epitope between amino acids 659-1832 of a TcdB. Examples include B59-3; B60-2; and B56-6.

Combinations of Antibodies

The anti-toxin antibody or binding fragment thereof can be administered in combination with other anti-*C. difficile* toxin antibodies (e.g., other monoclonal antibodies, polyclonal gamma-globulin) or a binding fragment thereof. Combinations that can be used include an anti-toxin A antibody or binding fragment thereof and an anti-toxin B antibody or binding fragment thereof.

In another embodiment, a combination includes an anti-toxin A antibody or binding fragment thereof and another anti-toxin A antibody or binding fragment thereof. Preferably, the combination includes a neutralizing anti-toxin A monoclonal antibody or binding fragment thereof and another neutralizing anti-toxin A monoclonal antibody or binding fragment thereof. Surprisingly, the inventors discovered that such a combination resulted in a synergistic effect in neutralization of toxin A cytotoxicity. For example, the combination includes a combination of at least two of the following neutralizing anti-toxin A monoclonal antibodies: A3-25; A65-33; A60-22; and A80-29. More preferably, the combination includes A3-25 antibody and at least one of the following neutralizing anti-toxin A monoclonal antibodies: A65-33; A60-22; and A80-29. Most preferably, the combination includes all four antibodies: A3-25; A65-33; A60-22; and A80-29.

In a further embodiment, a combination includes an anti-toxin B antibody or binding fragment thereof and another anti-toxin B antibody or binding fragment thereof. Preferably, the combination includes a neutralizing anti-toxin B monoclonal antibody or binding fragment thereof and another neutralizing anti-toxin B monoclonal antibody or binding fragment thereof. Surprisingly, the inventors discovered that such a combination resulted in a synergistic effect in neutralization of toxin B cytotoxicity. More preferably, the combination includes a combination of at least two of the following neutralizing anti-toxin B monoclonal antibodies: B8-26; B9-30 and B59-3. Most preferably, the combination includes all three antibodies: B8-26; B9-30 and B59-3.

In yet another embodiment, a combination includes an anti-toxin B antibody or binding fragment thereof and another anti-toxin B antibody or binding fragment thereof. As stated previously, the inventors discovered that a combination of at least two of the neutralizing monoclonal antibodies can exhibit an unexpectedly synergistic effect in respective neutralization of toxin A and toxin B.

In another embodiment, the agents of the invention can be formulated as a mixture, or chemically or genetically linked using art recognized techniques thereby resulting in covalently linked antibodies (or covalently linked antibody fragments), having both anti-toxin A and anti-toxin B binding properties. The combined formulation may be guided by a determination of one or more parameters such as the affinity, avidity, or biological efficacy of the agent alone or in combination with another agent.

Such combination therapies are preferably additive and/or synergistic in their therapeutic activity, e.g., in the inhibition, prevention (e.g., of relapse), and/or treatment of *C. difficile*—related diseases or disorders. Administering such combination therapies can decrease the dosage of the therapeutic agent (e.g., antibody or antibody fragment mixture, or crosslinked or genetically fused bispecific antibody or antibody fragment) needed to achieve the desired effect.

It is understood that any of the inventive compositions, for example, an anti-toxin A and/or anti-toxin B antibody or binding fragment thereof, can be combined in different ratios or amounts for therapeutic effect. For example, the anti-toxin A and anti-toxin B antibody or respective binding fragment thereof can be present in a composition at a ratio in the range of 0.1:10 to 10:0.1, A:B. In another embodiment, the anti-toxin A and anti-toxin B antibody or respective binding fragment thereof can be present in a composition at a ratio in the range of 0.1:10 to 10:0.1, B:A.

In another aspect, the invention relates to a method of producing a neutralizing antibody against a *C. difficile* TcdA. The method includes administering an immunogenic composition as described above to a mammal, and recovering the antibody from the mammal. In a preferred embodiment, the immunogenic composition includes a mutant *C. difficile* TcdA having SEQ ID NO: 4, wherein at least one amino acid of the mutant *C. difficile* TcdA is chemically crosslinked, preferably by formaldehyde or 1-ethyl-3-(3-dimethylamino-propyl) carbodiimide. Exemplary neutralizing antibodies against TcdA that may be produced include A65-33; A60-22; A80-29 and/or A3-25.

In yet another aspect, the invention relates to a method of producing a neutralizing antibody against a *C. difficile* TcdB. The method includes administering an immunogenic composition as described above to a mammal, and recovering the antibody from the mammal. In a preferred embodiment, the immunogenic composition includes a mutant *C. difficile* TcdB having SEQ ID NO: 6, wherein at least one amino acid of the mutant *C. difficile* TcdB is chemically crosslinked, preferably by formaldehyde or 1-ethyl-3-(3-dimethylamino-propyl) carbodiimide. Exemplary neutralizing antibodies against TcdB that may be produced include B2-31; B5-40, B70-2; B6-30; B9-30; B59-3; B60-2; B56-6; and/or B8-26.

Formulations

Compositions of the present invention (such as, e.g., compositions including a mutant *C. difficile* toxin, immunogenic compositions, antibodies and/or antibody binding fragments thereof described herein) may be in a variety of forms. These include, for example, semi-solid and solid dosage forms, suppositories, liquid forms, such as liquid solutions (e.g., injectable and infusible solutions), dispersions or suspensions, liposomes, and/or dried form, such as, for example, lyophilized powder form, freeze-dried form, spray-dried form, and/or foam-dried form. For suppositories, binders and carriers include, for example, polyalkylene glycols or triglycerides; such suppositories can be formed from mixtures containing the inventive compositions. In an exemplary embodiment, the composition is in a form that is suitable for solution in, or suspension in, liquid vehicles prior to injection. In another exemplary embodiment, the composition is emulsified or encapsulated in liposomes or microparticles, such as polylactide, polyglycolide, or copolymer.

In a preferred embodiment, the composition is lyophilized and extemporaneously reconstituted prior to use.

In one aspect, the present invention relates to pharmaceutical compositions that include any of the compositions described herein (such as, e.g., compositions including a mutant *C. difficile* toxin, immunogenic compositions, antibodies and/or antibody binding fragments thereof described herein), formulated together with a pharmaceutically acceptable carrier. "Pharmaceutically acceptable carriers" include any solvents, dispersion media, stabilizers, diluents, and/or buffers that are physiologically suitable.

Exemplary stabilizers include carbohydrates, such as sorbitol, mannitol, starch, dextran, sucrose, trehalose, lactose, and/or glucose; inert proteins, such as albumin and/or casein; and/or other large, slowly metabolized macromolecules, such as polysaccharides such as chitosan, polylactic acids, polyglycolic acids and copolymers (such as latex functionalized SEPHAROSE™ agarose, agarose, cellulose, etc/), amino acids, polymeric amino acids, amino acid copolymers, and lipid aggregates (such as oil droplets or liposomes). Additionally, these carriers may function as immunostimulating agents (i.e., adjuvants).

Preferably, the composition includes trehalose. Preferred amounts of trehalose (% by weight) include from a minimum of about 1%, 2%, 3%, or 4% to a maximum of about 10%, 9%, 8%, 7%, 6%, or 5%. Any minimum value can be combined with any maximum value to define a suitable range. In one embodiment, the composition includes about 3%-6% trehalose, most preferably, 4.5% trehalose, for example, per 0.5 mL dose.

Examples of suitable diluents include distilled water, saline, physiological phosphate-buffered saline, glycerol, alcohol (such as ethanol), Ringer's solutions, dextrose solution, Hanks' balanced salt solutions, and/or a lyophilization excipient.

Exemplary buffers include phosphate (such as potassium phosphate, sodium phosphate); acetate (such as sodium acetate); succinate (such as sodium succinate); glycine; histidine; carbonate, Tris (tris(hydroxymethyl)aminomethane), and/or bicarbonate (such as ammonium bicarbonate) buffers. Preferably, the composition includes tris buffer. Preferred amounts of tris buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM tris buffer, most preferably, 10 mM tris buffer, for example, per 0.5 mL dose.

In another preferred embodiment, the composition includes histidine buffer. Preferred amounts of histidine buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM histidine buffer, most preferably, 10 mM histidine buffer, for example, per 0.5 mL dose.

In yet another preferred embodiment, the composition includes phosphate buffer. Preferred amounts of phosphate buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM phosphate buffer, most preferably, 10 mM phosphate buffer, for example, per 0.5 mL dose.

The pH of the buffer will generally be chosen to stabilize the active material of choice, and can be ascertainable by those in the art by known methods. Preferably, the pH of the buffer will be in the range of physiological pH. Thus, preferred pH ranges are from about 3 to about 8; more preferably, from about 6.0 to about 8.0; yet more preferably, from about 6.5 to about 7.5; and most preferably, at about 7.0 to about 7.2.

In some embodiments, the pharmaceutical compositions may include a surfactant. Any surfactant is suitable, whether it is amphoteric, non-ionic, cationic or anionic. Exemplary surfactants include the polyoxyethylene sorbitan esters surfactants (e.g., TWEEN®), such as polysorbate 20 and/or polysorbate 80; polyoxyethylene fatty ethers derived from lauryl, cetyl, stearyl and oleyl alcohols (known as Brij surfactants), such as triethyleneglycol monolauryl ether (Brij 30); Triton X 100, or t-octylphenoxypolyethoxyethanol; and sorbitan esters (commonly known as the SPANs), such as sorbitan trioleate (Span 85) and sorbitan monolaurate, and combinations thereof. Preferred surfactants include polysorbate 80 (polyoxyethylene sorbitan monooleate).

Preferred amounts of polysorbate 80 (% by weight) include from a minimum of about 0.001%, 0.005%, or 0.01%, to a maximum of about 0.010%, 0.015%, 0.025%, or 1.0%. Any minimum value can be combined with any maximum value to define a suitable range. In one embodiment, the composition includes about 0.005%-0.015% polysorbate 80, most preferably, 0.01% polysorbate 80.

In an exemplary embodiment, the immunogenic composition includes trehalose and phosphate 80. In another exemplary embodiment, the immunogenic composition includes tris buffer and polysorbate 80. In another exemplary embodiment, the immunogenic composition includes histidine buffer and polysorbate 80. In yet another exemplary embodiment, the immunogenic composition includes phosphate buffer and polysorbate 80.

In one exemplary embodiment, the immunogenic composition includes trehalose, tris buffer and polysorbate 80. In another exemplary embodiment, the immunogenic composition includes trehalose, histidine buffer and polysorbate 80. In yet another exemplary embodiment, the immunogenic composition includes trehalose, phosphate buffer and polysorbate 80.

The compositions described herein may further include components of petroleum, animal, vegetable, or synthetic origin, for example, peanut oil, soybean oil, and/or mineral oil. Examples include glycols such as propylene glycol or polyethylene glycol.

In some embodiments, the pharmaceutical composition further includes formaldehyde. For example, in a preferred embodiment, a pharmaceutical composition that further includes formaldehyde has an immunogenic composition, wherein the mutant C. difficile toxin of the immunogenic composition has been contacted with a chemical crosslinking agent that includes formaldehyde. The amount of formaldehyde present in the pharmaceutical composition may vary from a minimum of about 0.001%, 0.002%, 0.003%, 0.004%, 0.005%, 0.006%, 0.007%, 0.008%, 0.009%, 0.010%, 0.013%, or 0.015%, to a maximum of about 0.020%, 0.019%, 0.018%, 0.017% 0.016%, 0.015%, 0.014%, 0.013%, 0.012% 0.011% or 0.010%. Any minimum value can be combined with any maximum value to define a suitable range. In one embodiment, the pharmaceutical composition includes about 0.010% formaldehyde.

In some alternative embodiments, the pharmaceutical compositions described herein do not include formaldehyde. For example, in a preferred embodiment, a pharmaceutical composition that does not include formaldehyde has an immunogenic composition, wherein at least one amino acid of the mutant C. difficile toxin is chemically crosslinked by an agent that includes EDC. More preferably, in such an embodiment, the mutant C. difficile toxin has not been contacted with a chemical crosslinking agent that includes formaldehyde. As another exemplary embodiment, a pharmaceutical composition that is in a lyophilized form does not include formaldehyde.

In another embodiment, the compositions described herein may include an adjuvant, as described below. Preferred adjuvants augment the intrinsic immune response to an immunogen without causing conformational changes in the immunogen that may affect the qualitative form of the immune response.

Exemplary adjuvants include 3 De-O-acylated monophosphoryl lipid A (MPL™) (see GB 2220211 (GSK)); an aluminum hydroxide gel such as Alhydrogel™ (Brenntag Biosector, Denmark); aluminum salts (such as aluminum hydroxide, aluminum phosphate, aluminum sulfate), which may be used with or without an immunostimulating agent such as MPL or 3-DMP, QS-21, polymeric or monomeric amino acids such as polyglutamic acid or polylysine.

Yet another exemplary adjuvant is an immunostimulatory oligonucleotide such as a CpG oligonucleotide (see, e.g., WO 1998/040100, WO2010/067262), or a saponin and an immunostimulatory oligonucleotide, such as a CpG oligonucleotide (see, e.g., WO 00/062800). In a preferred embodiment, the adjuvant is a CpG oligonucleotide, most preferably a CpG oligodeoxynucleotides (CpG ODN). Preferred CpG ODN are of the B Class that preferentially activate B cells. In aspects of the invention, the CpG ODN has the nucleic acid sequence 5' T*C*G*T*C*G*T*T*T*T*T*T*C*G*G*T*G*C*T*T*T*T 3' (SEQ ID NO: 48) wherein * indicates a phosphorothioate linkage. The CpG ODN of this sequence is known as CpG 24555, which is described in WO2010/067262. In a preferred embodiment, CpG 24555 is used together with an aluminium hydroxide salt such as Alhydrogel.

A further class of exemplary adjuvants include saponin adjuvants, such as Stimulon™ (QS-21, which is a triterpene glycoside or saponin, Aquila, Framingham, Mass.) or particles generated therefrom such as ISCOMs (immune stimulating complexes) and ISCOMATRIX® adjuvant. Accordingly, the compositions of the present invention may be delivered in the form of ISCOMs, ISCOMS containing CTB, liposomes or encapsulated in compounds such as acrylates or poly(DL-lactide-co-glycoside) to form microspheres of a size suited to adsorption. Typically, the term "ISCOM" refers to immunogenic complexes formed between glycosides, such as triterpenoid saponins (particularly Quil A), and antigens which contain a hydrophobic region. In a preferred embodiment, the adjuvant is an ISCOMATRIX adjuvant.

Other exemplary adjuvants include RC-529, GM-CSF and Complete Freund's Adjuvant (CFA) and Incomplete Freund's Adjuvant (IFA).

Yet another class of exemplary adjuvants is glycolipid analogues including N-glycosylamides, N-glycosylureas and N-glycosylcarbamates, each of which is substituted in the sugar residue by an amino acid.

Optionally, the pharmaceutical composition includes two or more different adjuvants. Preferred combinations of adjuvants include any combination of adjuvants including, for example, at least two of the following adjuvants: alum, MPL, QS-21, ISCOMATRIX, CpG, and Alhydrogel. An exemplary combination of adjuvants includes a combination of CpG and Alhydrogel.

Alternatively, in one embodiment, the composition is administered to the mammal in the absence of an adjuvant.

Compositions described herein can be administered by any route of administration, such as, for example, parenteral, topical, intravenous, mucosal, oral, subcutaneous, intraarterial, intracranial, intrathecal, intraperitoneal, intranasal, intramuscular, intradermal, infusion, rectal, and/or transdermal routes for prophylactic and/or therapeutic applications. In a preferred embodiment, the route of administration of the composition is parenteral, more preferably, intramuscular administration. Typical intramuscular administration is performed in the arm or leg muscles.

Compositions described herein can be administered in combination with therapies that are at least partly effective in prevention and/or treatment of C. difficile infection. For example, a composition of the invention may be administered before, concurrently with, or after biotherapy; probiotic therapy; stool implants; immunotherapy (such as intravenous immunoglobulin); and/or an accepted standard of care for the antibiotic treatment of C. difficile associated disease (CDAD), such as metronidazole and/or vancomycin.

A composition of the present invention relating to toxin A and toxin B may be administered to the mammal in any combination. For example, an immunogenic composition including a mutant C. difficile TcdA may be administered to the mammal before, concurrently with, or after administration of an immunogenic composition including a mutant *C. difficile* TcdB. Conversely, an immunogenic composition including a mutant *C. difficile* TcdB may be administered to the mammal before, concurrently with, or after administration of an immunogenic composition including a mutant *C. difficile* TcdA.

In another embodiment, a composition including an anti-toxin A antibody or binding fragment thereof may be administered to the mammal before, concurrently with, or after administration of a composition including an anti-toxin B antibody or binding fragment thereof. Conversely, a composition including an anti-toxin B antibody or binding fragment thereof may be administered to the mammal before, concurrently with, or after administration of a composition including an anti-toxin A antibody or binding fragment thereof.

In a further embodiment, a composition of the present invention may be administered to the mammal before, concurrently with, or after administration of a pharmaceutically acceptable carrier. For example, an adjuvant may be administered before, concurrently with, or after administration of a composition including a mutant *C. difficile* toxin. Accordingly, a composition of the present invention and a pharmaceutically acceptable carrier can be packaged in the same vial or they can be packaged in separate vials and mixed before use. The compositions can be formulated for single dose administration and/or multiple dose administration.

Methods of Protecting and/or Treating *C. difficile* Infection in a Mammal

In one aspect, the invention relates to a method of inducing an immune response to a *C. difficile* toxin in a mammal. The method includes administering an effective amount of a composition described herein to the mammal. For example, the method may include administering an amount effective to generate an immune response to the respective *C. difficile* toxin in the mammal.

In an exemplary embodiment, the invention relates to a method of inducing an immune response to a *C. difficile* TcdA in a mammal. The method includes administering an effective amount of an immunogenic composition that includes a mutant *C. difficile* TcdA to the mammal. In another exemplary embodiment, the invention relates to a method of inducing an immune response to a *C. difficile* TcdB in a mammal. The method includes administering an effective amount of an immunogenic composition that includes a mutant *C. difficile* TcdB to the mammal.

In a further embodiment, the method includes administering an effective amount of an immunogenic composition that includes a mutant *C. difficile* TcdA and an effective amount of an immunogenic composition that includes a mutant *C. difficile* TcdB to the mammal. In additional aspects, the compositions described herein may be used to treat, prevent, decrease risk of, decrease severity of, decrease occurrences of, and/or delay outset of a *C. difficile* infection, *C. difficile* associated disease, syndrome, condition, symptom, and/or complication thereof in a mammal, as compared to a mammal to which the composition is not administered. The method includes administering an effective amount of the composition to the mammal.

Three clinical syndromes caused by *C. difficile* infection are recognized, based on the severity of the infection. The most severe form is pseudomembranous colitis (PMC), which is characterized by profuse diarrhea, abdominal pain, systemic signs of illness, and a distinctive endoscopic appearance of the colon.

Antibiotic-associated colitis (AAC) is also characterized by profuse diarrhea, abdominal pain and tenderness, systemic signs (e.g., fever), and leukocytosis. Intestinal injury in AAC is less severe than in PMC, the characteristic endoscopic appearance of the colon in PMC is absent, and mortality is low.

Finally, antibiotic-associated diarrhea (AAD, which is also known as *C. difficile* associated diarrhea (CDAD) is a relatively mild syndrome, and is characterized by mild to moderate diarrhea, lacking both large intestinal inflammation (as characterized by, e.g., abdominal pain and tenderness) and systemic signs of infection (e.g., fever).

These three distinct syndromes typically occur in an increasing order of frequency. That is, PMC typically occurs less frequently than AAC, and AAD is typically the most frequent clinical presentation of *C. difficile* disease.

A frequent complication of *C. difficile* infection is recurrent or relapsing disease, which occurs in up to 20% of all subjects who recover from *C. difficile* disease. Relapse may be characterized clinically as AAD, AAC, or PMC. Patients who relapse once are more likely to relapse again.

As used herein, conditions of a *C. difficile* infection include, for example, mild, mild-to-moderate, moderate, and severe *C. difficile* infection. A condition of *C. difficile* infection may vary depending on presence and/or severity of symptoms of the infection.

Symptoms of a *C. difficile* infection may include physiological, biochemical, histologic and/or behavioral symptoms such as, for example, diarrhea; colitis; colitis with cramps, fever, fecal leukocytes, and inflammation on colonic biopsy; pseudomembranous colitis; hypoalbuminemia; anasarca; leukocytosis; sepsis; abdominal pain; asymptomatic carriage; and/or complications and intermediate pathological phenotypes present during development of the infection, and combinations thereof, etc. Accordingly, for example, administration of an effective amount of the compositions described herein may, for example treat, prevent, decrease risk of, decrease severity of, decrease occurrences of, and/or delay outset of diarrhea; abdominal pain, cramps, fever, inflammation on colonic biopsy, hypoalbuminemia, anasarca, leukocytosis, sepsis, and/or asymptomatic carriage, etc., as compared to a mammal to which the composition was not administered.

Risk factors of a *C. difficile* infection may include, for example, present or immediate future use of an antimicrobial (any antimicrobial agent with an antibacterial spectrum and/or activity against anaerobic bacteria are encompassed, including, for example, antibiotics that cause disruption of normal colonic microbiotak, e.g., clindamycin, cephalosporins, metronidazole, vancomycin, fluoroquinolones (including levofloxacin, moxifloxacin, gatifloxacin, and ciprofloxacin), linezolid, etc.); present or immediate future withdrawal of prescribed metronidazole or vancomycin; present or immediate future admission to a healthcare facility (such as a hospital, chronic care facility, etc.) and healthcare workers; present or immediate future treatment with proton-pump inhibitors, H2 antagonists, and/or methotrexate, or a combination thereof; present or risk of gastrointestinal diseases, such as inflammatory bowel disease; past, present, or immediate future gastrointestinal surgery or gastrointestinal procedure on the mammal; past or present recurrence of a *C. difficile* infection and/or a CDAD, e.g., patients who have had a *C. difficile* infection and/or a CDAD once or more than once; and humans aged at least about 65 and above.

In the methods described herein, the mammal may be any mammal, such as, for example, mice, hamsters, primates, and humans. In a preferred embodiment, the mammal is a human. According to the present invention, the human may include individuals who have exhibited a *C. difficile* infection, *C. difficile* associated disease, syndrome, condition, symptom, and/or complication thereof; individuals who are presently exhibiting a *C. difficile* infection, *C. difficile* associated disease, syndrome, condition, symptom, and/or complication thereof; and individuals who are at risk of a *C. difficile* infection, *C. difficile* associated disease, syndrome, condition, symptom, and/or complication thereof.

Examples of individuals who have shown symptoms of *C. difficile* infection include individuals who have shown or are showing symptoms described above; individuals who have had or are having a *C. difficile* infection and/or a *C. difficile* associated disease (CDAD); and individuals who have a recurrence of a *C. difficile* infection and/or CDAD.

Examples of patients who are at risk of a *C. difficile* infection include individuals at risk of or are presently undergoing planned antimicrobial use; individuals at risk of or are presently undergoing withdrawal of prescribed metronidazole or vancomycin; individuals who are at risk of or are presently undergoing a planned admission to a healthcare facility (such as a hospital, chronic care facility, etc.) and healthcare workers; and/or individuals at risk of or are presently undergoing a planned treatment with proton-pump inhibitors, H2 antagonists, and/or methotrexate, or a combination thereof; individuals who have had or are undergoing gastrointestinal diseases, such as inflammatory bowel disease; individuals who have had or are undergoing gastrointestinal surgery or gastrointestinal procedures; and individuals who have had or are having a recurrence of a *C. difficile* infection and/or a CDAD, e.g., patients who have had a *C. difficile* infection and/or a CDAD once or more than once; individuals who are about 65 years old or older. Such at-risk patients may or may not be presently showing symptoms of a *C. difficile* infection.

In asymptomatic patients, prophylaxis and/or treatment can begin at any age (e.g., at about 10, 20, or 30 years old). In one embodiment, however, it is not necessary to begin treatment until a patient reaches at least about 45, 55, 65, 75, or 85 years old. For example, the compositions described herein may be administered to an asymptomatic human who is aged 50-85 years.

In one embodiment, the method of preventing, decreasing risk of, decreasing severity of, decreasing occurrences of, and/or delaying outset of a *C. difficile* infection, *C. difficile* associated disease, syndrome, condition, symptom, and/or complication thereof in a mammal includes administering an effective amount of a composition described herein to a mammal in need thereof, a mammal at risk of, and/or a mammal susceptible to a *C. difficile* infection. An effective amount includes, for example, an amount sufficient to prevent, decrease risk of, decrease severity of, decrease occurrences of, and/or delay outset of a *C. difficile* infection, *C. difficile* associated disease, syndrome, condition, symptom, and/or complication thereof in a mammal, as compared to a mammal to which the composition is not administered. Administration of an effective amount of the compositions described herein may, for example, prevent, decrease risk of, decrease severity of, decrease occurrences of, and/or delay outset of diarrhea; abdominal pain, cramps, fever, inflammation on colonic biopsy, hypoalbuminemia, anasarca, leukocytosis, sepsis, and/or asymptomatic carriage, etc., as compared to a mammal to which the composition was not administered. In a preferred embodiment, the method includes administering an effective amount of an immunogenic composition described herein to the mammal in need thereof, the mammal at risk of, and/or the mammal susceptible to a *C. difficile* infection.

In an additional embodiment, the method of treating, decreasing severity of, and/or delaying outset of a *C. difficile* infection, *C. difficile* associated disease, syndrome, condition, symptom, and/or complication thereof in a mammal includes administering an effective amount of a composition described herein to a mammal suspected of, or presently suffering from a *C. difficile* infection. An effective amount includes, for example, an amount sufficient to treat, decrease severity of, and/or delay the outset of a *C. difficile* infection, *C. difficile* associated disease, syndrome, condition, symptom, and/or complication thereof in a mammal, as compared to a mammal to which the composition is not administered.

Administration of an effective amount of the composition may improve at least one sign or symptom of *C. difficile* infection in the subject, such as those described below. Administration of an effective amount of the compositions described herein may, for example, decrease severity of and/or decrease occurrences of diarrhea; decrease severity of and/or decrease occurrences of abdominal pain, cramps, fever, inflammation on colonic biopsy, hypoalbuminemia, anasarca, leukocytosis, sepsis, and/or asymptomatic carriage, etc., as compared to a mammal to which the composition was not administered. Optionally, the presence of symptoms, signs, and/or risk factors of an infection is determined before beginning treatment. In a preferred embodiment, the method includes administering an effective amount of an antibody and/or binding fragment thereof described herein to the mammal suspected of, or presently suffering from, a *C. difficile* infection.

Accordingly, an effective amount of the composition refers to an amount sufficient to achieve a desired effect (e.g., prophylactic and/or therapeutic effect) in the methods of the present invention. For example, the amount of an immunogen for administration may vary from a minimum of about 1 μg, 5 μg, 25 μg, 50 μg, 75 μg, 100 μg, 200 μg, 500 μg, or 1 mg to a maximum of about 2 mg, 1 mg, 500 μg, 200 μg per injection. Any minimum value can be combined with any maximum value to define a suitable range. Typically about 10, 20, 50 or 100 μg per immunogen is used for each human injection.

The amount of a composition of the invention administered to the subject may depend on the type and severity of the infection and/or on the characteristics of the individual, such as general health, age, sex, body weight and tolerance to drugs. It may also depend on the degree, severity, and type of disease. An effective amount may also vary depending upon factors, such as route of administration, target site, physiological state of the patient, age of the patient, whether the patient is human or an animal, other therapies administered, and whether treatment is prophylactic or therapeutic. The skilled artisan will be able to determine appropriate amounts depending on these and other factors.

An effective amount may include one effective dose or multiple effective doses (such as, for example, 2, 3, 4 doses, or more) for use in the methods herein. Effective dosages may need to be titrated to optimize safety and efficacy.

A combination of amount and frequency of dose adequate to accomplish prophylactic and/or therapeutic uses is defined as a prophylatically- or therapeutically-effective regimen. In a prophylactic and/or therapeutic regimen, the composition is typically administered in more than one dosage until a sufficient immune response has been achieved. Typically, the immune response is monitored and repeated dosages are given if the immune response starts to wane.

The compositions may be administered in multiple dosages over a period of time. Treatment can be monitored by assaying antibody, or activated T-cell or B-cell responses to the therapeutic agent (e.g., the immunogenic composition including a mutant *C. difficile* toxin) over time. If the response falls, a booster dosage is indicated.

EXAMPLES

Example 1

Identification of Toxin-Negative *C. difficile* Strains

To identify *C. difficile* strains lacking toxin (A and B) genes and toxin expression, 13 *C. difficile* strains were tested. Culture media of 13 *C. difficile* strains were tested by ELISA for toxin A. Seven strains expressed toxin A: *C. difficile* 14797-2, *C. difficile* 630, *C. difficile* BDMS, *C. difficile* W1194, *C. difficile* 870, *C. difficile* 1253, and *C. difficile* 2149. See FIG. 3.

Six strains did not express toxin A and lacked the entire pathogenicity locus: *C. difficile* 1351 (ATCC 43593™), *C. difficile* 3232 (ATCC BAA-1801 ™), *C. difficile* 7322 (ATCC 43601™), *C. difficile* 5036 (ATCC 43603™), *C. difficile* 4811 (4 ATCC 3602™), and *C. difficile* VPI 11186 (ATCC 700057™). VPI 11186 was selected based upon its effectiveness to take up plasmid DNA by conjugation.

The same 13 strains were tested in a multiplex PCR assay using primers outside of the pathogenicity locus (PaLoc; Braun et al., *Gene*. 1996 Nov. 28; 181(1-2):29-38.). The PCR results demonstrated the DNA from the 6 toxin A negative strains by ELISA did not amplify any genes from the PaLoc (tcdA-tcdE). The PaLoc flanking sequences (cdd3 and cdu2) were present (data not shown).

Example 2

Inactivation of Sporulation Pathway in *C. difficile* VPI 11186

Knocking-out the spore-forming function of the *C. difficile* production strain facilitates large scale fermentation in a safe manufacturing environment. The ClosTron system was used to create an asporogenic *C. difficile* strain. See Heap et al., *J Microbiol Methods*. 2009 July; 78(1):79-85. The ClosTron system allows targeted gene inactivation with a group II intron for site directed insertional inactivation of a spo0A1 clostridial gene. The toxin-minus production strain VPI11186 was subjected to sporulation inactivation by the ClosTron technology. Erythromycin resistant mutants were selected and the presence of the insertional cassette was confirmed by PCR (not shown). The inability of two independent clones to form spores was confirmed.

Example 3

Genetic Modification of Toxin A and B Genes to Inactivate Cytotoxicity Function

Full-length mutant toxins A and B open reading frames (ORFs) based on strain 630Δ genome sequences were designed for custom synthesis at Blue Heron Biotech. See, for example, SEQ ID NOs: 9-14. The active site for the glucosyltransferase activity responsible for cellular toxicity was altered by two allelic substitutions: D285A/D287A (see SEQ ID NO: 3) for toxin A, and D286A/D288A (see SEQ ID NO: 5) for toxin B. Two nucleotides were mutated in each aspartate (D) codon to create the codon for alanine (A). See, for example, SEQ ID NOs: 9-14. In addition, a pair of vectors expressing mutant toxins lacking cysteine residues was constructed following custom synthesis at Blue Heron Biotech. Seven cysteine residues from mutant toxin A and 9 cysteine residues from mutant toxin B were replaced with alanine. The substitutions include catalytic cysteines of the A and B toxin autocatalytic protease. Also, silent mutations were introduced where necessary to eliminate restriction enzyme sites used for vector construction.

Example 4 pMTL84121fdx Expression Vector

The plasmid shuttle vector used for *C. difficile* mutant toxin antigen expression was selected from the pMTL8000-series modular system developed by the Minton lab (see Heap et al., *J Microbiol Methods*. 2009 July; 78(1):79-85). The chosen vector pMTL84121fdx contains the *C. difficile* plasmid pCD6 Gram+ replicon, the catP (chloramphenicol/thiamphenicol) selectable marker, the p15a Gram-replicon and tra function, and the *C. sporogenes* feredoxin promoter (fdx) and distal multiple cloning site (MCS). Empirical data suggested that the low-copy number p15a replicon conferred greater stability in *E. coli* than the ColE1 alternative. The fdx promoter was selected as it yielded higher expression than other promoters tested in experiments with CAT reporter constructs (e.g. tcdA, tcdB; or heterologous tetR or xylR) (data not shown).

Example 5

Cloning the Modified Toxin ORFS into pMTL84121fdx

Full-length mutant toxin A and B open reading frames (ORFs) based on strain 630Δ genome sequences were subcloned using pMTL84121fdx vector multiple cloning NdeI and Bg/II sites using standard molecular biology techniques. To facilitate cloning, the ORFs were flanked by a proximal NdeI site containing the start codon and a BgIII site just downstream of the stop codon.

Example 6

Site Directed Mutagenesis of TcdA to Create a Triple Mutant

The catalytic cysteine residue of the autocatalytic protease domain was substituted (i.e., C700A for TcdA and C698A for TcdB) in SEQ ID NOs: 3 and 5, i.e., in each of the "double mutants." For mutagenesis of mutant toxin A, a 2.48 kb NdeI-HindIII fragment from the TcdA D285A/D287A expression plasmid was subcloned into pUC19 (cut with same) and site-directed mutagenesis was performed on this template. Once the new alleles were confirmed by DNA sequence analysis, the modified NdeI-HindIII fragments were reintroduced into the expression vector pMTL84121 fdx to create the "triple mutants," i.e., SEQ ID NO: 4 and SEQ ID NO: 6.

Example 7

Site Directed Mutagenesis of TcdB to Create a Triple Mutant

For mutagenesis of mutant toxin B, a 3.29 kb NdeI-EcoNI fragment from the mutant toxin B plasmid was modified and reintroduced. As the EcoNI site is not present in available cloning vectors a slightly larger 3.5 kb NdeI-EcoRV fragment was subcloned into pUC19 (prepared with NdeI-SmaI). After mutagenesis, the modified internal 3.3 kb NdeI-EcoNI fragment was excised and used to replace the corresponding mutant toxin B expression vector pMTL84121fdx fragment. As the cloning efficiency of this directional strategy was found to be quite low, an alternative strategy for introducing the C698A allele involving replacement of a 1.5 kb DreIII was attempted in parallel. Both strategies independently yielded the desired recombinants.

Example 8

Creating Additional Mutant Toxin Variants by Site-Directed Mutagenesis

At least twelve different *C. difficile* mutant toxin variants were constructed. Allelic substitutions were introduced into N-terminal mutant toxin gene fragments by site directed mutagenesis (Quickchange® kit). Recombinant toxins were also engineered as reference controls to evaluate the capacity of this plasmid-based system to generate protein quantitatively equivalent in biological activity to native toxins purified from wild-type *C. difficile* strains. In this case, allelic substitutions were introduced to revert the original glucosyltransferase substitutions. In addition, a pair of cysteineless mutant toxin vectors was constructed following custom synthesis at Blue Heron Biotech.

The twelve toxin variants include (1) a mutant *C. difficile* toxin A having a D285A/D287A mutation (SEQ ID NO: 3); (2) a mutant *C. difficile* toxin B having a D286A/D288A mutation (SEQ ID NO: 5); (3) a mutant *C. difficile* toxin A having a D285A/D287A C700A mutation (SEQ ID NO: 4); (4) a mutant *C. difficile* toxin B having a D286A/D288A C698A mutation (SEQ ID NO: 6); (5) a recombinant toxin A having SEQ ID NO: 1; (6) a recombinant toxin B having SEQ ID NO: 2; (7) a mutant *C. difficile* toxin A having a C700A mutation; (8) a mutant *C. difficile* toxin B having a C698A mutation; (9) a mutant *C. difficile* toxin A having a C700A C597S, C1169S, C1407S, C1623S, C2023S, and C2236S mutation; (10) a mutant *C. difficile* toxin B having a C698A C395S, C595S, C824S, C870S, C1167S, C1625S, C1687S, and C2232S mutation; (11) a mutant *C. difficile* toxin A having a D285A, D287A, C700A, D269A, R272A, E460A, and R462A mutation (SEQ ID NO: 7); and (12) a mutant *C. difficile* toxin B having a D270A, R273A, D286A, D288A, D461A, K463A, and C698A mutation (SEQ ID NO: 8)

Example 9

Stability of Transformants

Rearranged plasmids were obtained with the commonly-used DH5α *E. coli* lab strain. In contrast, transformations using the Invitrogen Stbl2™ *E. coli* host yielded slow-growing full-length mutant toxin recombinants after three days of growth at 30° C. on LB chloramphenicol (25 µg/ml) plates. Lower cloning efficiencies were obtained with related Stbl3™ and Stbl4™ *E. coli* strains, although these lines were found to be stable for plasmid maintenance. Transformants were subsequently propagated in agar or in liquid culture under chloramphenicol selection at 30° C. The use of LB (Miller's) media was also found to improve the recovery and growth of transformants compared with animal-free tryptone-soy based media.

Example 10

Transformation of *C. difficile* with pMTL84121fdx Encoding Wild-Type or Genetic Mutant Toxin Genes Transformation of *C. difficile* by *E. coli* conjugal transfer was done essentially as described in Heap et al., *Journal of Microbiological Methods*, 2009. 78(1): p. 79-85. *E. coli* host CA434 was transformed with pMTL84121 fdx encoding wild type or variant mutant toxin genes. *E. coli* host CA434 is the intermediate to mobilize expression plasmids into the *C. difficile* production strain VPI 11186 spo0A1. CA434 is a derivative of *E. coli* HB101. This strain harbors the Tra+ Mob+R702 conjugative plasmid which confers resistance to Km, Tc, Su, Sm/Spe, and Hg (due to Tn1831). Chemically competent or electrocompetent CA434 cells were prepared and expression vector transformants were selected on Miller's LB CAM plates at 30° C. Slow growing colonies appearing after 3 days were picked and amplified in 3 mL LB chloramphenicol cultures until mid-log phase (~24 h, 225 rpm, orbital shaker at 30° C.). *E. coli* cultures were harvested by low speed (5,000 g) centrifugation to avoid breaking pili, and cell pellets were resuspended gently with a wide-bore transfer pipette in 1 mL PBS. Cells were concentrated by low speed centrifugation. Most of the PBS was removed by inversion and the drained pellets were transferred into the anaerobic chamber and resuspended with 0.2 mL of *C. difficile* culture, spotted onto BHIS agar plates and left to grow for 8 h or overnight. In the case of mutant toxin A transformants, better results were achieved with overnight conjugation. Cell patches were scraped into 0.5 mL PBS and 0.1 mL was plated on BHIS selection media supplemented with 15 µg/mL thiamphenicol (more potent analog of chloramphenicol) and D-cycloserine/cefoxitin to kill *E. coli* donor cells. Transformants appearing 16-24 h later were purified by re-streaking onto a new BHIS (plus supplements) plate and subsequent cultures were tested for expression of recombinant toxins or mutant toxins. Glycerol permanents and seed stocks were prepared from clones showing good expression. Plasmid minipreps were also prepared from 2 mL cultures using a modified Qiagen kit procedure in which cells were pretreated with lysozyme (not essential). The *C. difficile* miniprep DNA was used as a template for PCR sequencing to verify clone integrity. Alternatively, plasmid maxiprep DNA was prepared from *E. coli* Stbl2™ transformants and sequenced.

Example 11

*C. difficile* Expression Analysis of the Toxin A and B Triple Mutant (SEQ ID NOs: 4 and 6, Respectively) and Hepta B Mutant (SEQ ID NO: 8)

Transformants were grown either in 2 mL cultures (for routine analysis) or in vent-capped flasks (for time course experiments). Samples (2 mL) were centrifuged briefly (10, 000 rpm, 30s) to concentrate the cells: supernatants were decanted and concentrated 10× (Amicon-ultra 30 k); pellets were drained and frozen at −80° C. Cell pellets were thawed on ice, resuspended in 1 mL lysis buffer (Tris-HCl pH7.5; 1 mM EDTA, 15% glycerol) and sonicated (1× 20 s burst with microtip). The lysate was centrifuged at 4° C. and supernatant was concentrated 5-fold. Samples of supernatant and lysate were combined with sample buffer and heat treated (10 min, 80° C.) before loading onto duplicate 3-8% Tris-acetate SDS-PAGE gels (Invitrogen). One gel was stained with Coomassie, the second was electroblotted for western analysis. Toxin A-specific and Toxin B-specific rabbit antisera (Fitgerald; Biodesign) were used to detect mutant toxin A and B variants. Expression of the hepta mutant toxin B (SEQ ID NO: 8) was also confirmed by western blot hybridization.

Example 12

Abrogation of Glucosyltransferase Activity of the Mutant Toxins

Genetic double mutant (DM) toxins A and B (SEQ ID NOs: 3 and 5, respectively) and triple mutant (TM) toxins A and B (SEQ ID NOs: 4 and 6, respectively) did not transfer $^{14}$C-glucose to 10 μg of RhoA, Rac1 and Cdc42 GTPases in in vitro glucosylation assays in the presence of UDP-$^{14}$C-glucose [30 μM], 50 mM HEPES, pH 7.2, 100 mM KCl, 4 mM MgCl$_2$, 2 mM MnCl$_2$, 1 mM DTT, and 0.1 μg/μL BSA. However, wild-type A and B toxin controls (having SEQ ID NOs: 1 and 2, respectively) transferred $^{14}$C-glucose to GTPases efficiently at a low dose of 10 and 1 ng each (and lower-data not shown) (FIGS. 4A and 4B), even in the presence of 100 μg of mutant toxin (FIG. 4B) indicating at least 100,000-fold reduction compared to respective wild-type toxins. Similar results were detected for Cdc42 GTPase (data not shown).

Specifically, in FIG. 4B, wild-type toxin A and toxin B (1 ng) or triple mutant toxin A and triple mutant toxin B (100 μg) were incubated with RhoA GTPase in the presence of UDP-$^{14}$C-glucose for 2 hr at 30° C. As illustrated, 1 ng of wild-type TcdA and TcdB transferred $^{14}$C-glucose to RhoA but 100 μg of triple mutant toxin A and triple mutant toxin B did not. When 1 ng of wild-type TcdA or TcdB was spiked into the reaction with respective 100 μg of triple mutant toxin A or triple mutant toxin B, glucosylation of RhoA was detected, indicating the lack of glucosylation inhibitors. The sensitivity of detection for the glucosylation activity was established to be 1 ng of wild-type toxin in a background of 100 μg mutant toxin (ratio of 1:100,000). The results show that the mutations in the active site of the glucosyltransferase in the triple mutant toxin A and triple mutant toxin B reduced any measurable (less than 100,000-fold lower activity compared to the activity of the respective wild-type toxins) glucosyltransferase activity. A similar assay was also developed to quantify glucosyltransferase activity by TCA precipitation of glucosylated GTPases.

Example 13

Abrogation of Auto-Catalytic Cysteine Protease Activity

Figure 5:
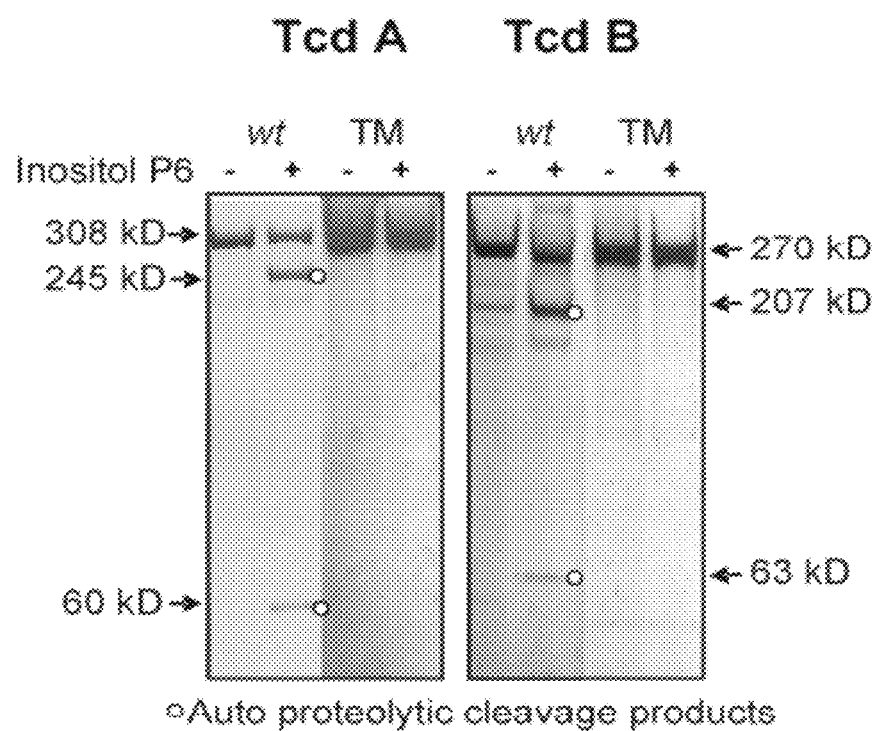
FIG. 5: Western blot indicating abrogation of cysteine protease activity in mutant toxins A and B (SEQ ID NOs: 4 and 6, respectively), as compared to observation of cleaved fragments of wild-type toxins A and B (SEQ ID NOs: 1 and 2, respectively). See Example 13.

The function of auto-catalytic cleavage was abrogated in the triple genetic mutants A and B (TM) (SEQ ID NOs: 4 and 6, respectively) when the cysteine protease cleavage site was mutated. As illustrated in FIG. 5, the wild type (wt) toxins A and B (SEQ ID NOs: 3 and 5, respectively) are cleaved in the presence of inositol-6-phosphate. The double mutant toxins A and B (SEQ ID NOs: 3 and 5, respectively) are also cleaved in the presence of inositol-6-phosphate (data not shown), similar to that for wild-type. Toxin A (SEQ ID NO: 3) is cleaved from 308 kDa into 2 fragments of 245 and 60 kDa. Toxin B (SEQ ID NO: 5) is cleaved from 270 kDa into two fragments of 207 and 63 kDa. The triple genetic mutants A and B (TM) (SEQ ID NOs: 4 and 6, respectively) remain unaffected at 308 and 270 kDa respectively, even in the presence of inositol-6-phosphate. See FIG. 5. Therefore, the cysteine protease activity was inactivated by genetic modification.

More specifically, in FIG. 5, one μg of triple mutant A and triple mutant B were incubated for 90 minutes at room temperature (21±5° C.) in parallel with wild-type TcdA and TcdB from List Biologicals. The cleavage reaction was performed in 20 μL volume in Tris-HCl, pH 7.5, 2 mM DTT in the presence or absence of inositol-6-phosphate (10 mM for TcdA and 0.1 mM for Tcd B). The entire reaction volume was then loaded on a 3-8% SDS/PAGE; the protein bands were visualized by silver staining. As illustrated, wt Tcd A and TcdB were cleaved into two protein bands of 245 kD and 60 kD and 207 kD and 63 kD, respectively, in the presence of inositol-6-phosphate. The triple mutant toxin A and triple mutant toxin B were not cleaved, thus confirming the C700A mutation in triple mutant toxin A and C698A mutation in triple mutant toxin B blocked cleavage.

Example 14

Residual Cytotoxicity of Triple Mutant Toxins A and B (SEQ ID NOs: 4 and 6, Respectively)

The genetic mutant toxins were evaluated for their cytotoxicity by an in vitro cytotoxicity assay in IMR90 cells, a human diploid lung fibroblast cell line. These cells are sensitive to both toxin A and B. As an alternative preferred embodiment, Vero normal kidney cells from *Cercopithecus aethiops* may be used in the cytotoxicity assay since they were observed to have reasonable sensitivities to toxin A and B. Preferably, HT-29 human colorectal adenocarcinoma cells are not used in the cytotoxicity assay because they have shown significantly decreased sensitivities to the toxins, as compared to the Vero and IMR90 cell lines. See, for example, Table 6 below.

TABLE 6

Cell Line Sensitivities to Toxins A and B*

| Cell line | Toxin | | $EC_{50}$ (pg/ml) | |
|---|---|---|---|---|
| | | 50 μg/ml Cells/well | 48 hours | 72 hours |
| Vero | A | 10000 | 1816 | 244 |
| (ATCC CCL-81 ™) | B | 10000 | 62 | 29 |
| IMR90 | A | 10000 | 1329 | 1152 |
| (ATCC CCL-186 ™) | B | 10000 | 14 | 13 |
| HT-29 | A | 10000 | >1E6 | >1E6 |
| (ATCC HTB-38 ™) | B | 10000 | 11089 | 53313 |

*In vitro cytotoxicity assay was performed by measuring cellular ATP using luciferase-based substrate, CellTiter-Glo ® (Promega, Madison, WI)

Figure 6:
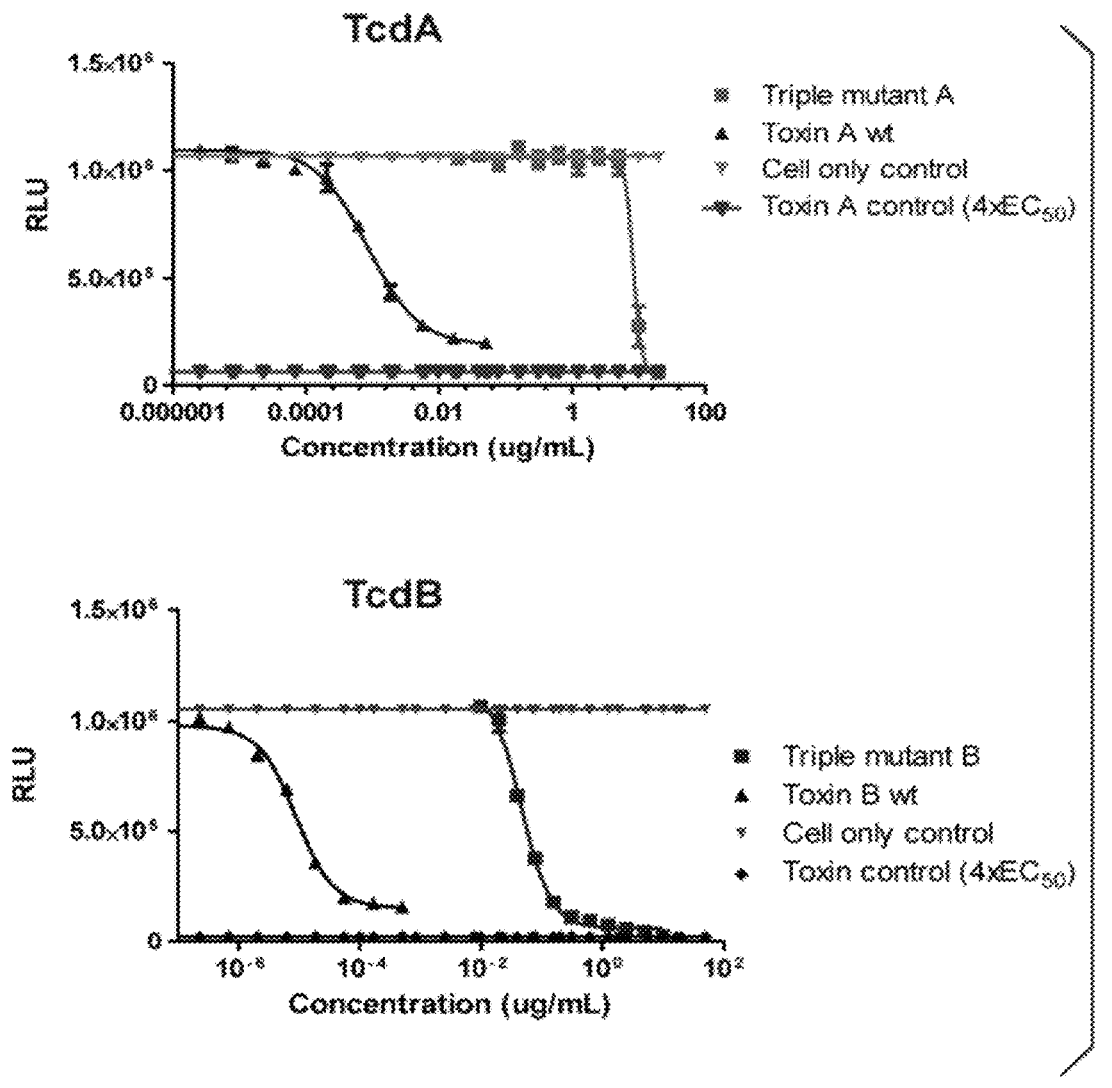

Serially diluted genetic mutant toxin or wt toxin samples were added to the cell monolayers grown in 96-well tissue culture plates. After incubation at 37° C. for 72 h, the plates were evaluated for metabolically active cells by measuring cellular ATP levels by addition of luciferase based CellTiter-Glo® reagent (Promega, Madison, Wis.) generating luminescence expressed as relative luminescence units (RLUs). High RLUs show that the cells are viable, low RLUs show that the cells are not metabolically active and are dying. The level of cytotoxicity, expressed as $EC_{50}$, is defined as the amount of wt toxin or genetic mutant toxin that elicits a 50% reduction in RLUs compared to levels in cell culture controls (details of this assay are provided below). As shown in FIG. 6, Tables 7A, and Table 8A, the $EC_{50}$ values of TcdA and TcdB were about 0.92 ng/mL and 0.009 ng/mL, respectively. The $EC_{50}$ values of triple mutant toxin A and triple mutant toxin B were about 8600 ng/mL and 74 ng/mL, respectively. Despite an approximate 10,000-fold reduction in cytotoxicity relative to wt toxins, both genetic mutant toxins still demonstrated low residual levels of cytotoxicity. This residual cytotoxicity could be blocked by neutralizing antitoxin monoclonal antibodies indicating that it was specific to the triple mutant toxins but not likely related to the known enzymatic activities of the wt toxins (glucosylation or autoproteolysis).

Both wt toxins exhibit potent in vitro cytotoxicity, with small amounts of the toxins being sufficient to cause various effects on mammalian cells such as cell rounding (cytopathic effect or CPE) and lack of metabolic activity (as measured by ATP levels). Consequently, two in vitro assays (a CPE or cell rounding assay and an ATP assay) have been developed to verify that no residual cytotoxicity in the mutant toxin drug substances remains. The results are expressed as $EC_{50}$, which is the amount of toxin or mutant toxin that causes 1) 50% of the cells to develop CPE or 2) 50% reduction in ATP levels as measured in relative light units.

In the CPE assay, a sample of drug substance is serially diluted and incubated with IMR90 cells, which are observed for a potential cytopathic effect. The CPE assay is scored on a scale of 0 (normal cells) to 4 (~100% cell rounding) and a score of 2 (~50% cell rounding) is defined as $EC_{50}$ value of the test sample. This method is used for testing of mutant toxin drug substance at the concentration of 1000 µg/mL, which is the maximal tolerable concentration that can be tested in this assay without matrix interference. Consequently, no detectable cytotoxicity is reported as $EC_{50}$>1000 µg/ml.

The ATP assay is based on measurement of the amount of luminescence signal generated from ATP, which is proportional to the number of metabolically active cells. The maximal tolerable concentration that can be tested in this assay without assay interference is about 200 µg/mL. Therefore no detectable cytotoxity in this assay is reported as $EC_{50}$>200 µg/mL.

Different concentrations of mutant toxin A and B were added to cells in parallel with toxin controls. The endpoints of the assay were cell viability determined by cellular ATP levels using the CellTiter-Glo® (Promega). The degree of luminescence is proportional to ATP levels or viable cell number.

The in vitro cytotoxicity ($EC_{50}$) of wild type (wt) toxin A was 920 pg/mL and 9 pg/mL for toxin B. The in vitro cytotoxicity ($EC_{50}$) of mutant toxin A (SEQ ID NO: 4) was 8600 ng/mL and 74 ng/mL for mutant toxin B (SEQ ID NO: 6). Although these values represent reductions of 9348 and 8222-fold, respectively, residual cytotoxicity was detected in both mutant toxins.

In other words, the cytotoxicity of triple mutant toxins A and B (SEQ ID NOs: 4 and 6, respectively) was significantly reduced in the in vitro cytotoxicity assay in IMR-90 cells relative to the cytotoxicity of wt toxins A and B (SEQ ID NOs: 1 and 2, respectively). As illustrated in FIG. 6, although both triple mutant toxins exhibited significant reduction in cytotoxicity ($10^4$ fold) relative to the wt toxin, residual cytotoxicity was observed at higher concentrations of both triple mutant toxins.

Furthermore, the residual cytotoxicity of each triple mutant toxin could be completely neutralized (e.g., at least a 6-8 $log_{10}$ reduction in toxicity, relative to the wild-type toxin toxicity) by the toxin specific antibodies. See Example 16, below.

Cell culture assays are more sensitive for detection of cytotoxicity than in vivo animal models. When delivered by either i.p. or i.v routes in the mouse lethal challenge model, the wt TcdA has an $LD_{50}$ of ~50 ng per mouse while the wt TcdB is more potent with an $LD_{50}$ of ~5 ng per mouse. In contrast, the cell culture based in vitro assays described above have $EC_{50}$ values of 100 pg per well for wt TcdA and 2 pg per well for wt TcdB.

Example 15

Residual Cytotoxicity of the Genetic Hepta Mutant Toxin B (SEQ ID NO: 8)

Figure 7:
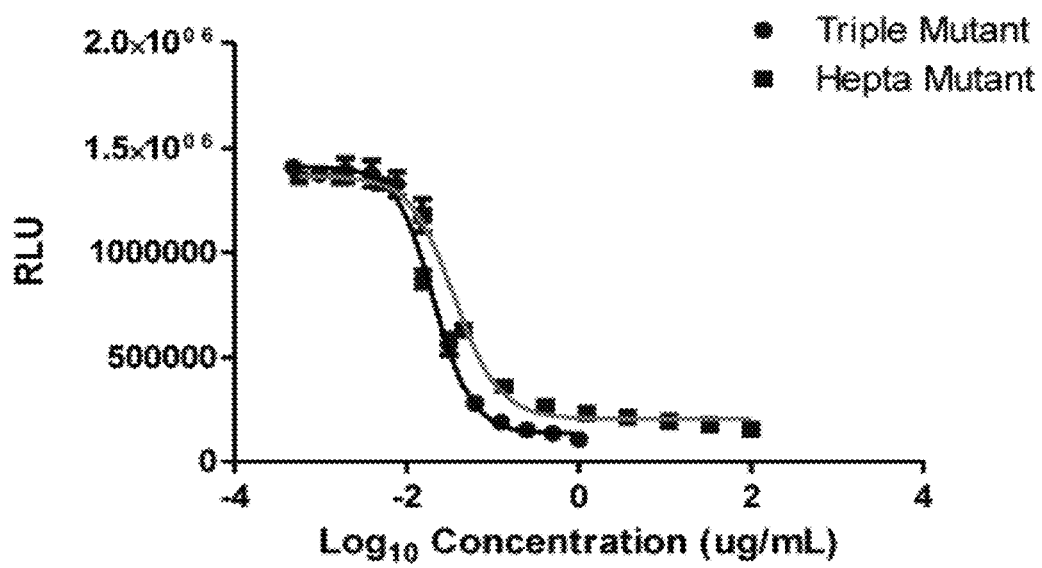
FIG. 7: Graph showing that $EC_{50}$, values are similar for the triple mutant toxin B (SEQ ID NO: 6) and hepta mutant toxin B (SEQ ID NO: 8).

As illustrated in FIG. 7, the $EC_{50}$ values are similar for the triple mutant toxin B (SEQ ID NO: 6) (20.78 ng/mL) and hepta mutant toxin B (SEQ ID NO: 8) (35.9 ng/mL) mutants indicating that the four additional mutations to further modify the glucosyltransferase active site and GTPase substrate binding site did not further reduce the cytotoxicity of the genetic mutant toxins. The $EC_{50}$ values were also similar for the double mutant toxin B (SEQ ID NO: 5) as they are for the triple and hepta mutant toxins (data not shown). This observation suggests the mechanism for cytotoxicity of the mutant toxins is surprisingly independent of the glucosyltransferase and substrate recognition mechanism.

Example 16

Residual Cytotoxicity of Triple Mutant Toxins A and B (SEQ ID NOs: 4 and 6, Respectively)

To further evaluate the nature of the residual cytotoxicity, the mutant toxins (SEQ ID NOs: 4 and 6) were mixed and incubated with their respective neutralizing antibodies before and the mixture was added to IMR90 cell monolayer.

Figure 8:
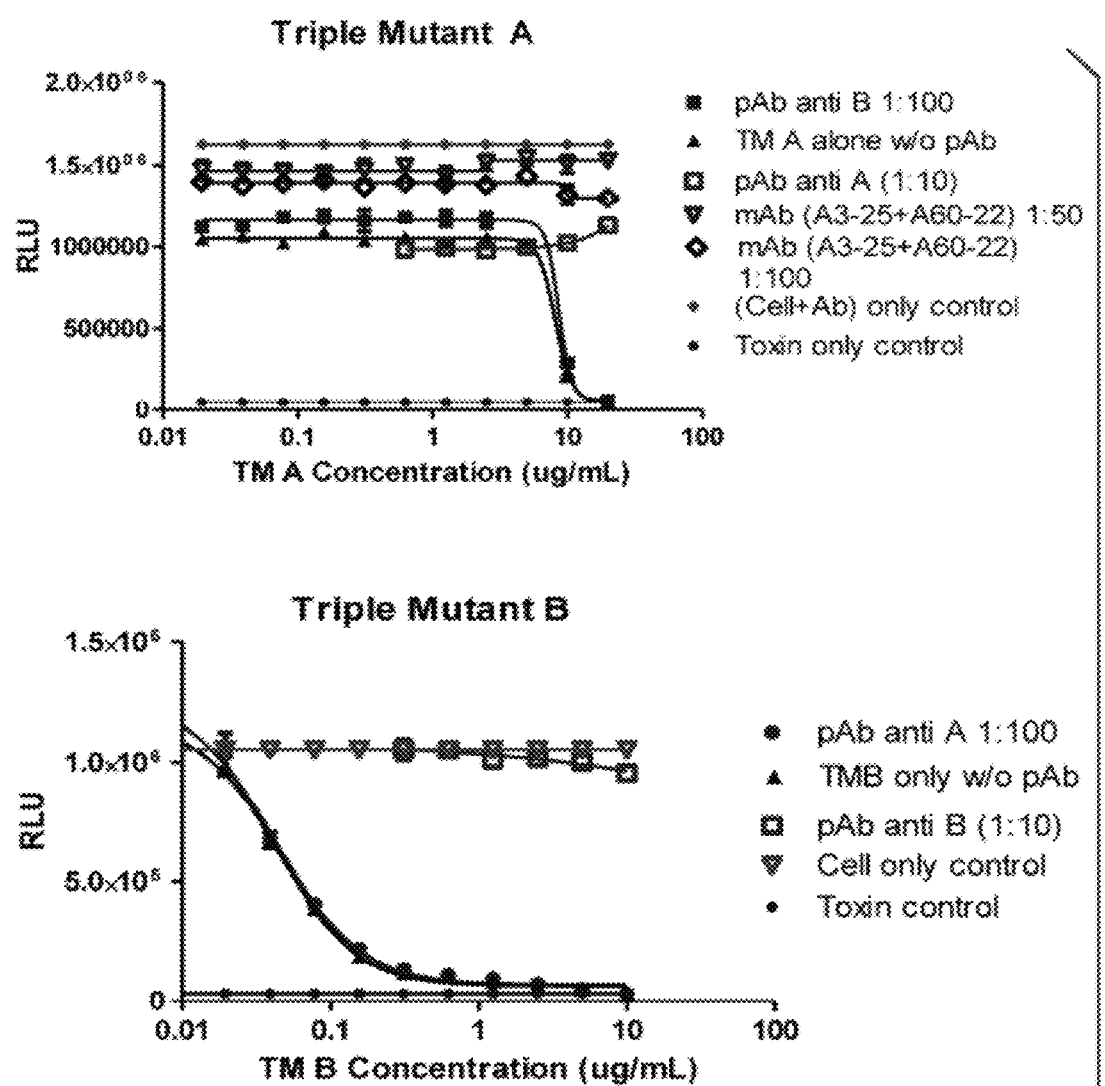
FIG. 8: Graph representing results from in vitro cytotoxicity tests in which the ATP levels (RLUs) are plotted against increasing concentrations of the triple mutant TcdA (SEQ ID NO: 4)(top panel) and triple mutant TcdB (SEQ ID NO: 6)(bottom panel). Residual cytotoxicity of mutant toxin A and B can be completely abrogated with neutralizing antibodies specific for mutant toxin A (top panel-pAb A and mAbs A3-25+A60-22) and mutant toxin B (bottom panel-pAb B).

The results (FIG. 8) showed that the residual cytotoxicity of mutant toxin A and B (SEQ ID NOs: 4 and 6, respectively) can be completely abrogated with neutralizing antibodies specific for mutant toxin A (top panel, FIG. 8) and mutant toxin B (bottom panel, FIG. 8). Increasing concentrations of mutant toxin A (top panel) and B (bottom panel) were incubated with rabbit anti-toxin polyclonal (pAb, 1:10 dilution) or murine monoclonal antibodies (1:50 dilution from a stock containing 3.0 mg IgG/mL) before adding to IMR90 cells. After 72-hr treatment incubation with IMR90 cells at 37° C., CellTiter-Glo® substrate was added and the relative light units (RLU) were measured in a spectrophotometer with the luminescence program to measure ATP levels. The lower the ATP level, the higher the toxicity. Controls included TcdA and TcdB added at 4 times their corresponding $EC_{50}$ values.

Published reports suggest that mutations in the glucosyltransferase or autocatalytic protease domain of the toxins result in complete inactivation of the toxicity. However, our data do not agree with these published reports and this could be attributed to increased concentrations of the highly purified mutant toxins tested in our studies as opposed to crude culture lysates in published reports; increased time points at which cell rounding of mutant toxin-treated cells was observed (e.g., 24 hours, 48 hours, 72 hours, or 96 hours) as opposed to observations made in less than 12 hours; use of cell lines that exhibit significantly higher sensitivities to toxins in present cytotoxicity assays in contrast to HT-29 human colorectal adenocarcinoma cells in cytotoxicity assays disclosed in published reports; and/or to an unknown activity or process, other than glycosylation, that could be driving the residual toxicity of the mutant toxins.

Example 17

Novel Mechanism of Cytotoxicity of Genetic Mutant Toxins

Figure 22:
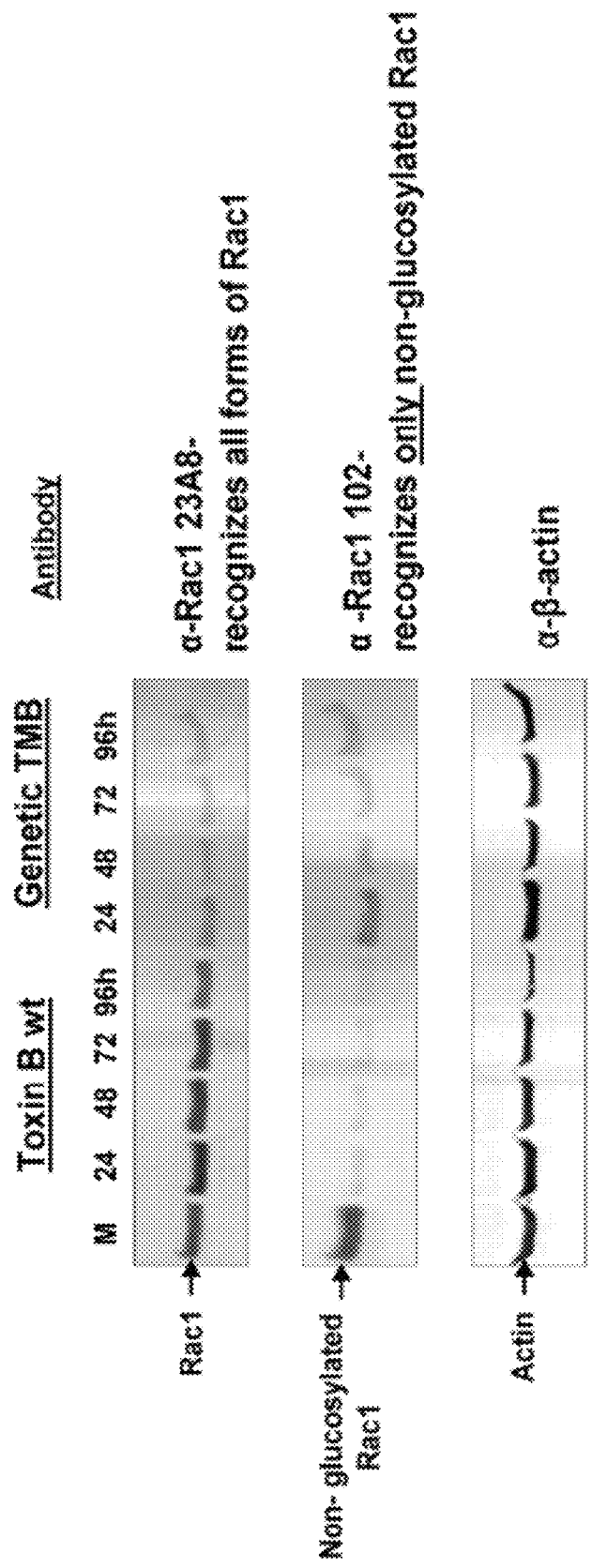
FIG. 22: Western blot showing that Rac1 GTPase expression is reduced in genetic mutant toxin B (SEQ ID NO: 6) extracts from 24 to 96 hours, but not in wild-type toxin B (SEQ ID NO: 2) treated extracts. The blot also shows that Rac1 is glucosylated in toxin B-treated extracts, but not in genetic mutant toxin B treated extracts.

To investigate the mechanism of residual cytotoxicity of the genetic mutant toxins, IMR-90 cells were treated with wt toxin B (SEQ ID NO: 2) or genetic mutant toxin B (SEQ ID NO: 6), and glucosylation of Rac1 GTPase was studied with time of treatment. Samples were collected from 24 to 96 hours and cell extracts were prepared. Glucosylated Rac1 is distinguished from non-glucosylated Rac1 by western blots with two antibodies to Rac1. One antibody recognizes both forms of Rac1 (23A8) and the other (102) only recognizes non-glucosylated Rac1. As illustrated in FIG. 22, for toxin B, the total Rac1 levels stayed unchanged over time with majority of the Rac1 being glucosylated. Treatment with the genetic mutant toxin B (SEQ ID NO: 6), on the other hand, resulted in significant reduction of total Rac1, however, the Rac1 was non-glucosylated at all time points. This shows that Rac1 level was negatively affected by the treatment with the genetic mutant toxin, but not by wt toxin. As illustrated in FIG. 22, the level of actin was similar in toxin and genetic mutant toxin B treated cells and similar to mock treated cells at indicated time points. This showed that the genetic mutant toxins exerted cytotoxicity by a mechanism which is different than the wild-type toxin-driven glucosylation pathway.

Example 18

Chemical Treatment of Genetic Mutant Toxins

Although the genetically modified mutant toxins showed a 4-log reduction in cytotoxic activity is preferred, further reduction (2 to 4 logs) in cytotoxic activity was considered. Two chemical inactivation strategies have been evaluated. The first method uses formaldehyde and glycine to inactivate the mutant toxins.

Formaldehyde inactivation occurs by forming a Schiff base (imine) between formaldehyde and primary amines on the protein. The Schiff bases can then react with a number of amino acid residues (Arg, His, Trp, Tyr, Gln, Asn) to form either intra- or intermolecular crosslinks. This crosslinking fixates the structure of the protein rendering it inactive. In addition, formaldehyde can react with glycine to from a Schiff base. The glycyl Schiff base can then react with the amino acid residues to form intermolecular protein-glycine crosslinks. Formaldehyde reduced the cytotoxic activity of the genetic mutant toxins to below detectable limits (reduction in cytotoxicity>8 $\log_{10}$ for triple mutant B (SEQ ID NO: 6) and >6 $\log_{10}$ for triple mutant A (SEQ ID NO: 4). However, reversion was observed over time when the formaldehyde-inactivated (FI) triple mutant toxins were incubated at 25° C. The cytotoxic reversion can be prevented by addition of a low amount of formaldehyde (0.01-0.02%) into the Fl-triple mutant toxins storage solution. See Example 23.

Another method uses 1-ethyl-3-(3-dimethylaminopropyl) carbodiimide (EDC)/N-hydroxysuccinimide (NHS) treatment to generate inactivated mutant toxins. In this method, EDC/NHS reacts with carboxylic groups on the protein to form activated esters. The activated esters can then react with primary amines on the protein to form stable amide bonds. As with the formaldehyde reaction, this reaction results in intra- and intermolecular crosslinks. The amide bond formed by treatment with EDC/NHS is more stable and non-reversible than the labile imine bond formed by formalin inactivation. In addition to crosslinks formed by the reaction of activated esters with primary amines on the polypeptide, both glycine and beta-alanine adducts can be formed. Without being bound by mechanism or theory, glycine adducts are produced when glycine is added to quench unreacted activated esters. The amine of glycine reacts with the activated ester on the polypeptide to form stable amide bonds. Without being bound by mechanism or theory, beta-alanine adducts are formed by the reaction of activated beta-alanine with primary amines on the polypeptide. This reaction results in stable amide bonds. Activated beta-alanine is produced by the reaction of three moles of NHS with one mole of EDC.

To achieve the 2-4 logs reduction of cytotoxic activity relative to the genetically modified mutant toxins (6-8 logs, relative to native toxins), the chemically inactivated mutant toxins should have $EC_{50}$, values of $\geq 1000$ µg/mL. In addition to reduction in cytotoxic activity, it would be advantageous to retain key epitopes as determined by dot-blot analysis. To date, a number of reaction conditions have been identified that meet both the reduction cytotoxicity and epitope recognition criteria. Several batches of inactivated mutant toxins have been prepared for animal studies and analytical data from a few representative batches is shown in Tables 7A and 7B, Table 8A and 8B.

TABLE 7A

Chemically Inactivated Mutant Toxin A is Safe and Antiqenic

| Sample # | Toxin Sample ID | Treatment | CPE $EC_{50}$ µg/mL | Reduction in toxicity Log Scale | Reactivities to mAbs |
|---|---|---|---|---|---|
| 1 | Mutant TcdA (SEQ ID NO: 4) L44905-160A | Formalin | >1000 | 6.4 | Medium/high |
| 2 | Mutant TcdA (SEQ ID NO: 4) 144166-166 | EDC | >1000 | 6.4 | High |
| 3 | Mutant TcdA (SEQ ID NO: 4) L44905-170A | Formalin | >1000 | 6.4 | Low |
| CONTROLS | | | | | |
| 4 | TcdA wt (from List Bio) | none | 390 pg/mL | 1 | High |
| 5 | TcdB wt (from List Bio) | none | 3.90 pg/mL | Not applicable | None |
| 6 | rMutant TcdA TM Genetic L36901-79 (SEQ ID NO: 4) | none | 12.5 µg/mL | 4.5 | High |
| 7 | Toxoid A List Bio | Formalin | Not Done | — | Low |

TABLE 7B

Chemically inactivated Mutant Toxin A is Safe and Antigenic

| | | | Reactivity with mAb (dot blot, nondenaturing conditions) | | | | | |
|---|---|---|---|---|---|---|---|---|
| | | | N-terminal | Mid-Domain | C-terminal (neut) | | | |
| Sample # | Toxin Sample ID | Treatment | mAb#6 | mAb #102 | A80-29 | A3-25 | A60-22 | A65-33 |
| 1 | Mutant TcdA (SEQ ID NO: 4) L44905-160A | Formalin | ++ | ++ | ++++ | ++ | ++++ | ++++ |
| 2 | Mutant TcdA (SEQ ID NO: 4) L44166-166 | EDC | ++++ | ++++ | ++++ | ++++ | ++++ | ++++ |
| 3 | Mutant TcdA (SEQ ID NO: 4) L44905-170A | Formalin | + | + | ++ | ++ | ++ | + |
| | | | CONTROLS | | | | | |
| 4 | TcdA wt (from List Bio) | none | ++++ | +++ | ++++ | ++++ | ++++ | ++++ |
| 5 | TcdB wt (from List Bio) | none | — | — | — | — | — | — |
| 6 | rMutant TcdA TM Genetic L36901-79 (SEQ ID NO: 4) | none | ++++ | ++++ | ++++ | ++++ | ++++ | ++++ |
| 7 | Toxoid A List Bio | Formalin | — | — | + | — | ++ | + |

List = List Biologicals; CPE = cytopathic effect assay; $EC_{50}$ = the lowest concentration where 50% of the cells show cytotoxicity; mAbs = monoclonal antibodies; neut = neutralizing; ND = not done; TM = active site and cleavage mutant ("triple mutant")

TABLE 8A

Chemically Inactivated Mutant Toxin B is Safe and Antigenic

| Sample # | Toxin Sample ID | Treatment | CPE $EC_{50}$ µg/mL | Reduction in toxicity Log Scale | Reactivities to mAbs |
|---|---|---|---|---|---|
| 1 | Mutant TcdB L44905-182 (SEQ ID NO: 6) | Formalin | >1000 | 8.4 | Medium/high |
| 2 | Mutant TcdB L34346-38A (SEQ ID NO: 6) | EDC | >1000 | 8.4 | High |
| 3 | Mutant TcdB L44905-170B (SEQ ID NO: 6) | Formalin | >1000 | 8.4 | Low |
| | | CONTROLS | | | |
| 4 | Tcda wt (from List Bio) | none | 390 pg/mL | Not applicable | None |
| 5 | TcdB wt (from List Bio) | none | 3.90 pg/mL | 1 | High |
| 6 | rMutant toxin B TM Genetic (SEQ ID NO: 6) L34346-022 | none | 69 ng/mL | 4.2 | High |
| 7 | Toxoid A List | Formalin | Not done | — | Medium |

TABLE 8B

Chemically Inactivated Mutant Toxin B is Safe and Antigenic

| | | | Reactivity with mAb (dot blot, nondenaturing conditions) | | | |
|---|---|---|---|---|---|---|
| | | | N-terminal aa 1-543 | | Mid-/C-terminal aa 544-2366 | |
| Sample # | Toxin Sample ID | Treatment | B8-26 | B9-30 | B56-6 | B59-3 |
| 1 | Mutant TcdB (SEQ ID NO: 6) L44905-160A | Formalin | +++ | +++ | ++ | ++ |
| 2 | Mutant TcdB (SEQ ID NO: 6) L44166-166 | EDC | ++++ | ++++ | ++++ | ++++ |
| 3 | Mutant TcdB (SEQ ID NO: 6) L44905-170A | Formalin | ++ | + | +/− | − |

TABLE 8B-continued

Chemically Inactivated Mutant Toxin B is Safe and Antigenic

| | | | Reactivity with mAb (dot blot, nondenaturing conditions) | | | |
|---|---|---|---|---|---|---|
| | | | N-terminal aa 1-543 | | Mid-/C-terminal aa 544-2366 | |
| Sample # | Toxin Sample ID | Treatment | B8-26 | B9-30 | B56-6 | B59-3 |
| CONTROLS | | | | | | |
| 4 | TcdA wt (from List Bio) | none | — | — | — | — |
| 5 | TcdB wt (from List Bio) | none | ++++ | +++ | ++++ | ++++ |
| 6 | rMutant TcdB TM Genetic L34346-022 (SEQ ID NO: 6) | none | ++++ | ++++ | ++++ | ++++ |
| 7 | Toxoid B List | Formalin | +++ | +++ | +++ | +++ |

List = List Biologicals; CPE = cytopathic effect assay; $EC_{50}$ = the concentration where 50% of the cells show cytotoxicity; mAbs = monoclonal antibodies; neut = neutralizing; ND = not done; TM = active site and cleavage mutant ("triple mutant")

Example 19

Purification

At the end of fermentation, the fermenter is cooled. The cell slurry is recovered by continuous centrifugation and resuspended in the appropriate buffer. Lysis of the cell suspension is achieved by high-pressure homogenization. For mutant toxin A, the homogenate is flocculated and the flocculated solution undergoes continuous centrifugation. This solution is filtered and then transferred for downstream processing. For mutant toxin B, the homogenate is clarified by continuous centrifugation, and then transferred for downstream processing.

Mutant toxin A (SEQ ID NO: 4) is purified using two chromatographic steps followed by a final buffer exchange. The clarified lysate is loaded onto a hydrophobic interaction chromatography (HIC) column and the bound mutant toxin is eluted using a sodium citrate gradient. The product pool from the HIC column is then loaded on a cation exchange (CEX) column and the bound mutant toxin A is eluted using a sodium chloride gradient. The CEX pool containing purified mutant toxin A is exchanged into the final buffer by diafiltration. The purified mutant toxin A is exchanged into the final drug substance intermediate buffer by diafiltration. After diafiltration, the retentate is filtered through a 0.2 micron filter prior to chemically inactivation to a final drug substance. The protein concentration is targeted to 1-3 mg/mL.

Mutant toxin B (SEQ ID NO: 6) is purified using two chromatographic steps followed by a final buffer exchange. The clarified lysate is loaded onto an anion exchange (AEX) column, and the bound mutant toxin is eluted using a sodium chloride gradient. Sodium citrate is added to the product pool from the AEX column and loaded on a hydrophobic interaction chromatography (HIC) column. The bound mutant toxin is eluted using a sodium citrate gradient. The HIC pool containing purified mutant toxin polypeptide (SEQ ID NO: 6) is exchanged into the final buffer by diafiltration. The purified mutant toxin B is exchanged into the final drug substance intermediate buffer by diafiltration. After diafiltration, the retentate is filtered through a 0.2 micron filter prior to chemically inactivation to a final drug substance. The protein concentration is targeted to 1-3 mg/mL.

Example 20

Formaldehyde/Glycine Inactivation

After purification, the genetic mutant toxins A and B (SEQ ID NOs: 4 and 6, respectively) are inactivated for 48 hours at 25° C. using 40 mM (1.2 mg/ml) of formaldehyde. The inactivation is carried out at pH 7.0±0.5 in 10 mM phosphate, 150 mM sodium chloride buffer containing 40 mM (3 mg/ml) glycine. The inactivation period is set to exceed three times the period needed for reduction in the $EC_{50}$, in IMR90 cells to greater than 1000 ug/mL. After 48 hours, the biological activity is reduced 7 to 8 $\log_{10}$ relative to the native toxin. Following the 48 hour incubation, the inactivated mutant toxin is exchanged into the final drug substance buffer by diafiltration. For example, using a 100 kD regenerated cellulose acetate ultrafiltration cassette, the inactivated toxin is concentrated to 1-2 mg/mL and buffer-exchanged.

Example 21

N-(3-Dimethylaminopropyl)-N'-ethylcarbodiimide (EDC)/N-hydroxysuccinimide (NHS) Inactivation After purification, the genetic mutant toxins (SEQ ID NO: 4 and SEQ ID NO: 6) are inactivated for 2 hours at 25° C. using 0.5 mg EDC and 0.5 mg NHS per mg of purified genetic mutant toxin A and B (approximately 2.6 mM and 4.4 mM respectively). The reaction is quenched by the addition of glycine to a final concentration of 100 mM and the reactions incubate for an additional 2 hours at 25° C. The inactivation is carried out at pH 7.0±0.5 in 10 mM phosphate, 150 mM sodium chloride buffer. The inactivation period is set to exceed three times the period needed for reduction in the $EC_{50}$, in IMR90 cells to greater than 1000 ug/mL. After 2 hours, the biological activity is reduced 7 to 8 $\log_{10}$ relative to the native toxin. Following the 4 hour incubation, the inactivated mutant toxin is exchanged into the final drug substance buffer by diafiltration. For example, using a 100 kD regenerated cellulose acetate ultrafiltration cassette, the inactivated toxin is concentrated to 1-2 mg/mL and buffer-exchanged. Unless otherwise stated, the following terms as used in the Examples section refer to a composition produced according to the present description in Example 21: "EDC/NHS-treated triple mutant toxin"; "EDC-inactivated mutant toxin"; "mutant toxin [A/B] drug substance"; "EI-mutant toxin";

"EDC/NHS-triple mutant toxin." For example, the following terms are synonymous: "EDC/NHS-treated triple mutant toxin A"; "EDC-inactivated mutant toxin A"; "mutant toxin A drug substance"; "EI-mutant toxin A"; "EDC/NHS-triple mutant toxin A." As another example, the following terms are synonymous: "EDC/NHS-treated triple mutant toxin B"; "EDC-inactivated mutant toxin B"; "mutant toxin B drug substance"; "EI-mutant toxin B"; "EDC/NHS-triple mutant toxin B."

The mutant toxin A drug substance and the mutant toxin B drug substance are each manufactured using a batch process, which includes (1) fermentation of a the toxin negative *C. difficile* strain (VPI 11186) containing a plasmid encoding the respective genetic triple mutant toxin polypeptide (in a medium including soy hydrolysate, yeast extract HY YEST™412 (Sheffield Bioscience), glucose, and thiamphenicol), (2) purification of the genetic mutant toxin (the "drug substance intermediate") from the cell-free lysate using ion exchange and hydrophobic interaction chromatographic procedures to at least greater than 95% purity, (3) chemical inactivation by treatment with EDC/NHS followed by quenching/capping with glycine, and (4) exchange into the final buffer matrix.

Example 22

Studies Supporting Conditions of Inactivation and Formulation

Figure 9:
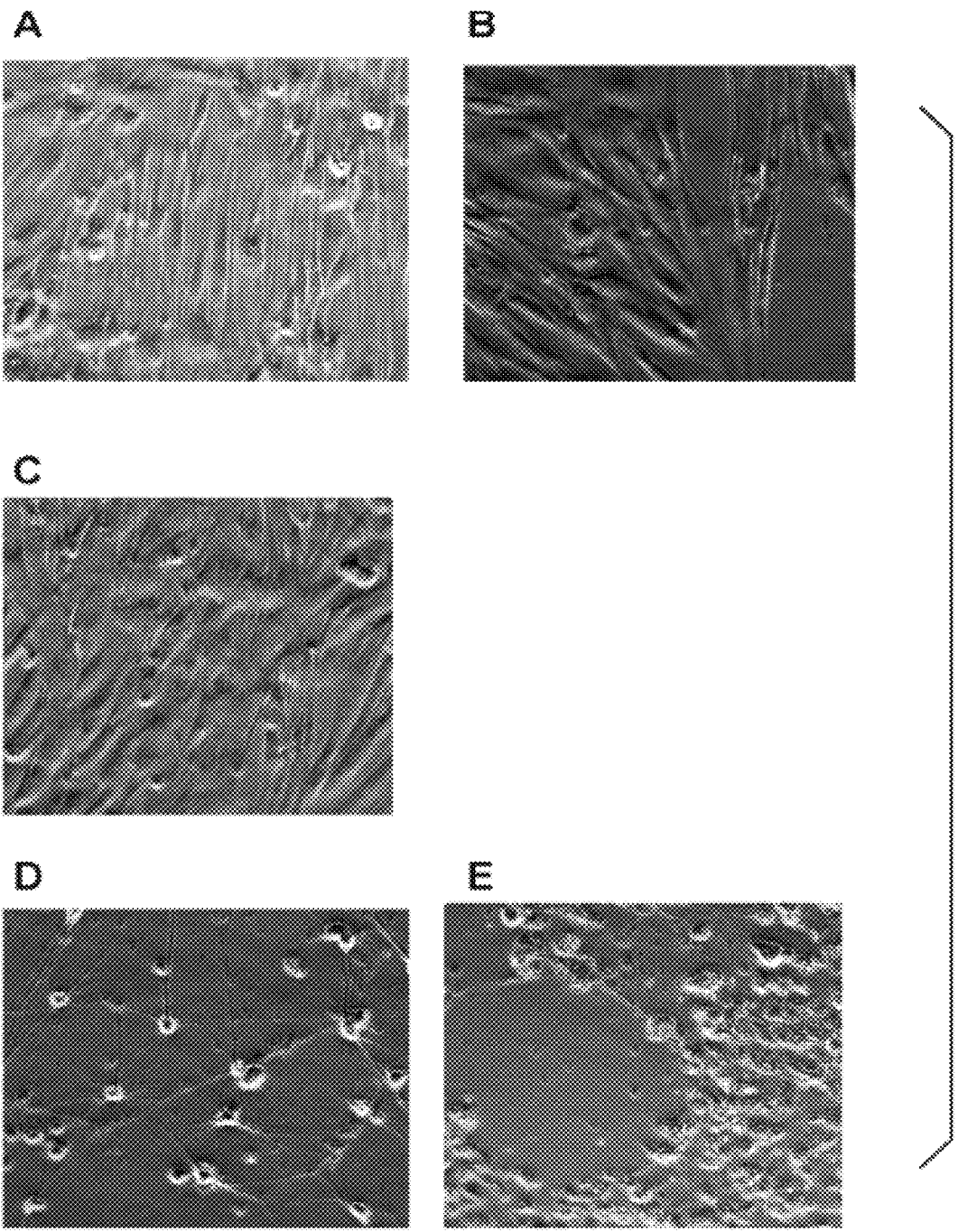
FIG. 9: Images of IMR-90 cell morphology at 72 hours post treatment. Panel A shows mock treated control cells. Panel B shows cell morphology following treatment with formalin inactivated mutant TcdB (SEQ ID NO: 6). Panel C shows cell morphology following treatment with EDC inactivated mutant TcdB (SEQ ID NO: 6). Panel D shows cell morphology following treatment with wild-type toxin B (SEQ ID NO: 2). Panel E shows cell morphology following treatment with triple mutant TcdB (SEQ ID NO: 6). Similar results were observed for TcdA treatments.

To optimize the chemical inactivation of the genetic mutant toxins, a statistical design of experiment (DOE) was performed. Factors examined in the DOE included temperature, formaldehyde/glycine concentration, EDC/NHS concentration and time (Table 9 and 10). To monitor loss of biological activity, $EC_{50}$, values in IMR90 cells were determined. In addition, cell morphology of IMR-90 cells various timepoints post-treatment were also observed. See FIG. 9, showing morphology at 72 hours post treatment. To determine the effect on protein structure, epitope recognition was monitored using dot-blot analysis using a panel of monoclonal antibodies raised against different domains of the toxin.

TABLE 9

Parameters Tested Formaldehyde/Glycine DOE

| Parameters | Range tested |
| --- | --- |
| Time (days) | 1 to 14 |
| Temperature (° C.) | 4 to 37 |
| Toxin concentration (mg/ml) | 1 to 1.25 |
| Formaldehyde concentration (mM) | 2 to 80 |
| Glycine concentration (mg/ml) | 0 to 80 |

TABLE 10

Parameters Tested EDC/NHS DOE

| Parameters | Range tested |
| --- | --- |
| Time (hours) | 1 to 4 |
| Temperature (° C.) | 25 to 35 |
| Toxin concentration (mg/ml) | 1 to 1.25 |
| EDC (mg/mg toxin) | 0.25 to 2.5 |
| NHS (mg/mg toxin) | 0 to 2.5 |

In the formaldehyde/glycine inactivation of *C. difficile* mutant toxins, final reaction conditions were chosen such that the desired level of reduction in cytotoxic activity (7 to 8 $\log_{10}$) was achieved while maximizing epitope recognition. See Example 20 above.

In the EDC/NHS inactivation of *C. difficile* mutant toxins, final reaction conditions were chosen such that the desired level of reduction in cytotoxic activity (7 to 8 $\log_{10}$) was achieved while maximizing epitope recognition. See Example 21 above.

In an alternative embodiment, the EDC-NHS reaction was quenched by addition of alanine, which sufficiently quenched the reaction. Use of alanine may result in a modification on the mutant toxin protein that is similar to the modification when the reaction is quenched by glycine. For example, quenching by adding alanine may result in an alanine moiety on a side chain of a glutamic acid and/or aspartic acid residue of the mutant toxin. In another alternative embodiment, the EDC-NHS reaction was quenched by addition of glycine methyl ester, which sufficiently quenched the reaction.

Production of chemically inactive triple mutant *C. difficile* toxin A and toxin B under optimized conditions resulted in a further reduction of residual cytotoxicity to an undetectable level (>1000 μg/mL—the highest concentration tested via the CPE assay), while retaining antigenicity as measured by their reactivity to the toxin-specific neutralizing antibodies. The results shown in Table 28 demonstrate a stepwise reduction in cytotoxicity from wt toxin through to EDC/NHS-treated triple mutant toxins. Immunofluorescence labelling confirmed that triple mutant toxins (SEQ ID NO: 4 and 6) and mutant toxin drug substances exhibited comparable binding to the IMR-90 cells suggesting that the cytotoxicity loss was not due to reduced binding to the cells (data not shown). Compared to mutant toxin A drug substance, the mutant toxin B drug substance achieved higher fold-reduction in cytotoxicity, which is consistent with the observed ~600-fold higher potency of TcdB compared to TcdA.

TABLE 28

Cytotoxicity Summary

| Toxin | Sample | $EC_{50}$ | Fold reduction in cytotoxicity |
| --- | --- | --- | --- |
| A | TcdA (SEQ ID NO: 1) | 1.6 ng/mL | 1 |
|  | Triple mutant toxin A (SEQ ID NO: 4) | 12.5 μg/mL | 7800 |
|  | Mutant toxin A Drug Substance | >1000 μg/mL | >625,000 |
| B | TcdB (SEQ ID NO: 2) | 2.5 pg/mL | 1 |
|  | Triple mutant toxin B (SEQ ID NO: 6) | 45 ng/mL | 18,000 |
|  | Mutant toxin B Drug Substance | >1000 μg/mL | >400,000,000 |

Cytotoxicity assay results for mutant toxin B modified by EDC alone, or by EDC and sulfo-NHS were also assessed. See Table 29.

TABLE 29

| Sample | Cytotoxicity $EC_{50}$, mg · $mL^{-1}$ (CPE) | Comment |
| --- | --- | --- |
| TcdB TM (SEQ ID NO: 6), unmodified | 0.03 |  |
| TM TcdB-EDC 1, no NHS | <0.97 | Reacted with EDC alone |
| TM TcdB-EDC 2, no NHS | <0.97 | Duplicate preparation |

TABLE 29-continued

| Sample | Cytotoxicity $EC_{50}$, mg · $mL^{-1}$ (CPE) | Comment |
|---|---|---|
| TM TcdB-EDC 3, sulfo-NHS (0.5x) | 125 | Reacted with EDC and sulfo-NHS |
| TM TcdB-EDC 4, sulfo-NHS (0.5x) | 125 | Duplicate preparation |
| TM TcdB-EDC 3, sulfo-NHS (1.0x) | 250 | Reacted with EDC and sulfo-NHS |
| TM TcdB-EDC 4, sulfo-NHS (2.0x) | 750 | Reacted with EDC and sulfo-NHS |

Conditions: Triple mutant toxin B ("TM TcdB") (SEQ ID NO: 6) was modified in the weight ratios mutant toxin B:EDC:sulfo-NHS=1:0.5:0.94. This ratio is the molar equivalent (corrected for higher MW of sulfo-NHS) to the standard EDC/NHS reaction as described in Example 21. To determine the affect of sulfo-NHS, the sulfo-NHS ratio was varied from 0.5× to 2× the standard ratio. Duplicate reactions were performed in 1×PBS pH 7.0 at 25° C., and were initiated by addition of EDC solution. After 2 hours, reactions were quenched by the addition of 1 M glycine pH 7.0 (0.1 M final concentration) and incubated for a further 2 hours. Quenched reactions were desalted and mutant toxin B drug substance ("TM TcdB-EDC") was concentrated using Vivaspin 20 devices, and sterile filtered into sterile vials and submitted for assessment in a cytotoxicity assay.

At the same molar ratio, sulfo-NHS reduced the $EC_{50}$, to about 250 ug/mL as compared to >1000 ug/mL for NHS. Even at twice the molar ratio, sulfo-NHS does not appear not as effective as NHS in decreasing cytotoxicity. See Table 30.

TABLE 30

| Modification | reference Digest (TcdB EDC 004) | NHS control digest (TcdB EDC 001) | Sulfo-NHS Sample Digest |
|---|---|---|---|
| glycine adduct (+57 da) | 49 | 29 | 35 |
| beta-alanine (+71 da) | 24 | 19 | 0 |
| crosslinks (−18 da) | 7 | 4 | 3 |
| dehydroalanine (−34 da) | 6 | 5 | 4 |
| Unmodified | 273 | 195 | 217 |

To determine the number and type of modifications, peptide mapping was performed on both EDC/NHS and EDC/sulfo-NHS inactivated triple mutant toxin B samples. Similar amounts of glycine adducts, crosslinks and dehydroalanine modifications were observed in both samples. However in the sulfo-NHS sample, no beta-alanine was observed.

Wild-type toxin B (SEQ ID NO: 2) was inactivated using the standard protocol (see Example 21); toxin B:EDC:NHS1:0.5:0.5, 25° C. for 2 hours in 1×PBS pH 7.0, then quench with 1 M glycine (0.1 M final concentration) and incubate for an additional 2 hours. The sample was desalted, concentrated and submitted for cytotoxicity assay. The $EC_{50}$, for this samples was <244 ng/mL.

Example 23

Reversion Studies

To determine if reversion occurs with either the formaldehyde/glycine or EDC/NHS inactivated *C. difficile* mutant toxins, samples of inactivated mutant toxins (1 mg/mL) were incubated at 25° C. for five-six weeks. Aliquots were removed each week and the $EC_{50}$ values in IMR90 cells were determined. One formaldehyde/glycine inactivated sample contained no formaldehyde and one sample contained 0.01% formaldehyde. The $EC_{50}$ was measured by the CPE assay.

TABLE 11

Results from Inactivated TcdA Reversion Study

| | $EC_{50}$ (IMR90 cell assay) | | |
|---|---|---|---|
| Time of Incubation (Days) | Formalin-inactivated | | EDC/NHS |
| | No formaldehyde | 0.01% formaldehyde | |
| 0 | 1000 ug/ml | 1000 ug/ml | 1000 ug/ml |
| 7 | 740 ug/mL | ND | 1000 ug/ml |
| 14 | 493 ug/mL | 1000 ug/ml | 1000 ug/ml |
| 21 | 395 ug/mL | ND | 1000 ug/ml |
| 28 | 395 ug/mL | 1000 ug/ml | 1000 ug/ml |
| 35 | 326 ug/M | ND | ND |

At 25° C. in the absence of residual formaldehyde, partial reversion is observed (Table 11). After five weeks, the cytotoxic activity increased approximately 3-fold. Although the cytotoxic activity increased, after five weeks there was still a 7 $\log_{10}$ reduction relative to the native toxin. Reversion was completely prevented by inclusion of formalin at a concentration of 0.010%. No reversion was observed in the EDC/NHS inactivated sample. Throughout the 6-week incubation, $EC_{50}$ values remained at the starting level of >1000 μg/mL for all four lots of both EDC/NHS-treated triple mutant toxin A (SEQ ID NO: 4) and EDC/NHS-treated triple mutant toxin B (SEQ ID NO: 6). In contrast, the $EC_{50}$ values of Fl-treated triple mutant toxin A (SEQ ID NO: 4) and Fl-treated triple mutant toxin B (SEQ ID NO: 6) were not stable and declined to unacceptably low $EC_{50}$ values, indicating an increase in cytotoxicity or reversion of inactivation. See Table 11.

In addition to stably reducing the cytotoxicity to an undetectable level (>1000 μg/mL, as measured by the CPE assay), mutant toxins inactivated using EDC/NHS retained important epitopes that are targets of toxin-neutralizing mAbs. See Table 31. FI mutant toxins showed a loss of the same antigenic determinants.

TABLE 31

EDC/NHS Inactivation Reduced Cytotoxicity of Genetic Mutant Toxins and Maintained Important Antigenic Determinants

| Sample | $EC_{50}$ | Reduction in cytotoxicity relative to wt toxin ($\log_{10}$)[a] | Max binding (Rmax)[b] Neut mAb[d] | | |
|---|---|---|---|---|---|
| | | | 1[c] | 2 | 3 |
| Triple mutant A (SEQ ID NO: 4) | 12.5 μg/mL | 4.5 | 100 | 100 | 100 |
| FI- Triple mutant A | >1000 μg/mL | >6.4 | 55 | 59 | 53 |

TABLE 31-continued

EDC/NHS Inactivation Reduced Cytotoxicity of Genetic Mutant
Toxins and Maintained Important Antigenic Determinants

| Sample | $EC_{50}$ | Reduction in cytotoxicity relative to wt toxin $(\log_{10})^a$ | Max binding (Rmax)[b] Neut mAb[d] | | |
|---|---|---|---|---|---|
| | | | 1[c] | 2 | 3 |
| EDC/NHS- Triple mutant A | >1000 µg/mL | >6.4 | 90 | 94 | 103 |
| Triple mutant B (SEQ ID NO: 6) | 69 ng/mL | 4.3 | 100 | 100 | 100 |
| FI-Triple mutant B | >1000 µg/mL | 8.4 | 67 | 67 | 36 |
| EDC/NHS-Triple mutant B | >1000 µg/mL | 8.4 | 87 | 78 | 73 |

[a]cytotoxicity was measured using the CPE assay on IMR90 cells
[b]values determined by Biacore™ analysis using multiple neutralizing mAbs directed at various non-overlapping toxin epitopes
[c]values are averages of two experiments
[d]For the first three rows, the neut mAb "1," "2," "3" refer to mAbs A60-22, A80-29, and A65-33 for toxin A, respectively. For the bottom three rows, the neut mAb "1," "2," "3" refer to mAbs B8-26, B59-3, and B-56-15 for toxin B, respectively.

Example 24

Preclinical Immunogenicity Studies

Key preclinical objectives include testing compositions including *C. difficile* mutant toxins A and B in small animals and nonhuman primates (NHP). Mice and hamsters were immunized to determine, among other things, if the *C. difficile* compositions are capable of eliciting neutralizing antibodies against the mutant toxin A and B. The antigens were tested for induction of serum neutralization antibody responses following a series of immunizations in mice, hamsters, and cynomolgus macaques. The genetic and/or chemically-inactivated mutant toxins were formulated in either neutral buffer, aluminum phosphate buffer, or buffer containing ISCOMATRIX as an adjuvant in some embodiments. Neutralizing antibody responses were generally tested about two to four weeks after each boost or the final dose.

The toxin neutralization assay demonstrates the ability of an antiserum to neutralize the cytotoxic effect mediated by *C. difficile* TcdA or TcdB and is therefore able to measure the functional activity of antibodies that are present in a sample. A toxin neutralization assay was performed on a human lung fibroblast cell line, IMR-90, which is sensitive to both TcdA and TcdB. Briefly, a 96-well microtiter plate was seeded with IMR-90 cells serving as the target of toxin-mediated cytotoxicity. Each test serum sample was analyzed separately for the ability to neutralize TcdA and TcdB. Appropriate serial dilutions of test antisera were mixed with a fixed concentrations of TcdA or TcdB and incubated at 37° C. for 90 minutes in a humidified incubator (37° C./5% $CO_2$) to allow for neutralization of the toxins to occur. For quality control, all plates included a Reference standard and controls which includes antitoxin antibodies of known titer. After 90 minutes, the toxin-antisera mixture was added to the IMR-90 cell monolayer and the plates were incubated for an additional 72 hours. Subsequently, CellTiter-Glo® substrate was added to the assay plate to determine the Adenosine Triphosphate (ATP) levels present in metabolically active cells and was measured as Relative Luminescence Units (RLU). A large ATP level indicates high cell viability, and levels are directly proportional to the amount of neutralization of the toxin by the antibody present in the sample. For preclinical data, the RLU data was plotted against the dilution value of the test antisera sample to generate a Four-Parameter Logistic (4-PL) regression response fit curve. The neutralization titers were expressed as the sample dilution value which exhibited 50% reduction in cytotoxicity.

Example 25

Mouse Immunogenicity Study: mu *C. difficile* 2010-06

The purpose of this study was to assess the immunogenicity of two forms of mutant *C. difficile* toxin B (SEQ ID NO: 6), each chemically-inactivated by different methods. In this study, the untreated mutant toxin B (SEQ ID NO: 6) (genetically inactivated but not chemically inactivated) was used as a control, with and without adjuvant.

Groups of 10 mice were immunized intramuscularly with 10 µg of an immunogen according to Table 12.

TABLE 12

Testing chemically inactivated mutant toxin B (SEQ ID NO: 6) in mice

| Group | Immunogen | Dose | No. | Route | Schedule |
|---|---|---|---|---|---|
| 1 | Formalin-Inactivated Mutant toxin B[a] in $AlPO_4$[c] | 10 µg | 10 | IM | Prime wk 0, Boost wks 4, 8 |
| 2 | Inactivated Mutant toxin B form 2[b] in $AlPO_4$[c] | 10 µg | 10 | IM | Prime wk 0, Boost wks 4, 8 |
| 3 | Genetic-Inactivated Mutant toxin B unadjuvanted | 10 µg | 10 | IM | Prime wk 0, Boost wks 4, 8, |
| 4 | Genetic-Inactivated Mutant toxin B in $AlPO_4$[c] | 10 µg | 10 | IM | Prime wk 0, Boost wks 4, 8, |

Figure 10:
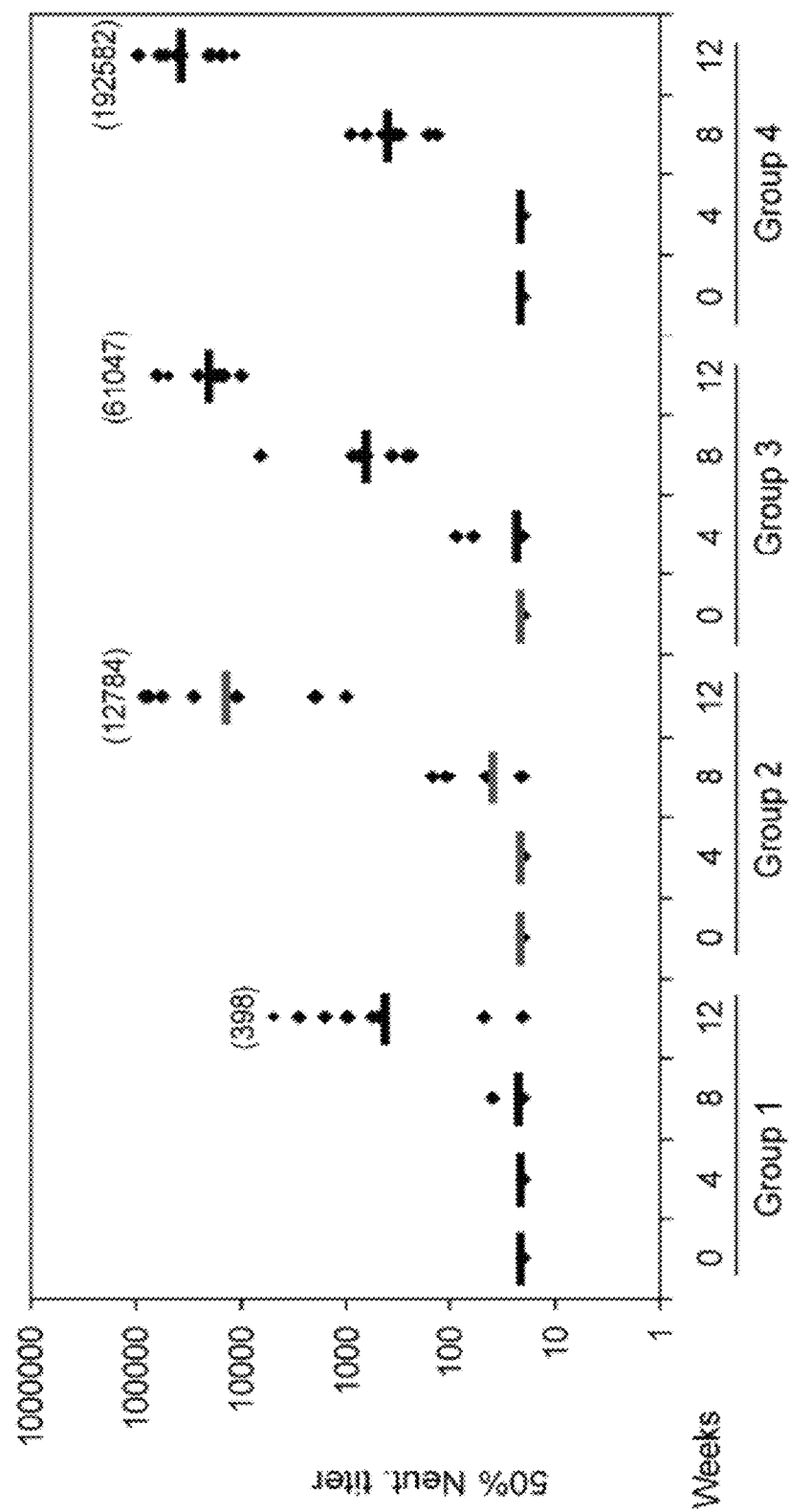
FIG. 10: Graph showing neutralizing antibody titers as described in Example 25 (study muCdiff2010-06).

[a]chemical inactivation = Formalin/glycine treated 10° C. for 7 days
[b]chemical inactivation = EDC/NHS treated, 30° C. for 2 hours
[c]aluminum ion concentration = 0.5 mg/mL Results: There were no adverse events in the mice following each administration of the vaccine candidates. As illustrated in FIG. 10, mice in each group developed significant robust anti-toxin B neutralizing antibodies after the third dose with the respective mutant toxins.

Based on the week 12 titers, it appears that in mice the EDC-inactivated mutant toxin B (Group 2) and the formalin-inactivated mutant toxins (Group 1) generated potent neutralizing responses.

In the absence of chemical inactivation, the genetic mutant toxin B (SEQ ID NO: 6) generated neutralizing responses after two doses (Groups 3-4, week 8), which were boosted after the third dose (Groups 3-4, week 12).

Example 26

Mouse immunogenicity study: mu C. difficile 2010-07

The purpose of this study was to assess immunogenicity of chemically inactivated C. difficile mutant toxins A and B (SEQ ID NOs: 4 and 6, respectively), either alone or in combination. The immunogens for all groups were formulated with aluminum phosphate as an adjuvant.

Groups of 5 mice were immunized intramuscularly with 10 µg of an immunogen according to Table 13.

TABLE 13

Testing Chemically Inactivated Genetic A and B mutant toxins (SEQ ID NOs: 4 and 6, respectively) in Mice

| Group | Immunogen | Dose | No. Group | Schedule |
|---|---|---|---|---|
| 1 | Formalin-Inactivated[a] Mutant toxin B (SEQ ID NO: 6) in AlPO$_4$[c] | 10 µg | 5  IM | Prime wk 0, Boost wks 4, 8, 12 |
| 2 | EDC-Inactivated[b] Mutant toxin B (SEQ ID NO: 6) in AlPO$_4$[c] | 10 µg | 5  IM | Prime wk 0, Boost wks 4, 8, 12 |
| 3 | Formalin-Inactivated Mutant toxin A (SEQ ID NO: 4) form 1 in AlPO$_4$[c] | 10 µg | 5  IM | Prime wk 0, Boost wks 4, 8, 12 |
| 4 | EDC-Inactivated Mutant toxin A (SEQ ID NO: 4) in AlPO$_4$[c] | 10 µg | 5  IM | Prime wk 0, Boost wks 4, 8, 12 |
| 5 | Formalin-Inactivated Mutant toxins A + B in AlPO$_4$[c] | 10 µg each | 5  IM | Prime wk 0, Boost wks 4, 8, 12 |

Figure 11A:
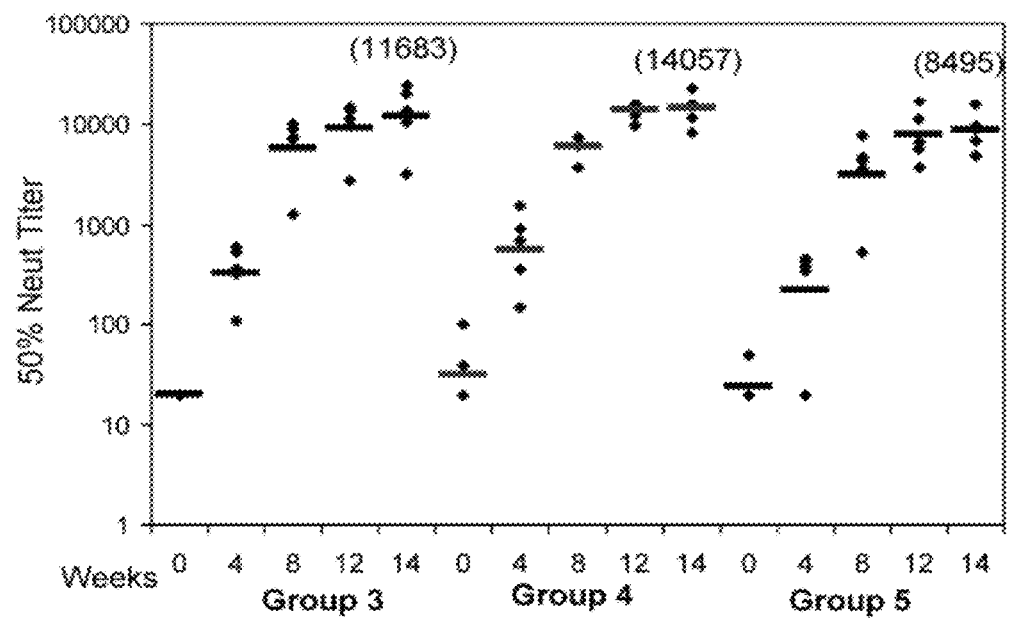
FIG. 11: Graph showing neutralizing antibody titers as described in Example 26 (study muCdiff2010-07).
Figure 11B:
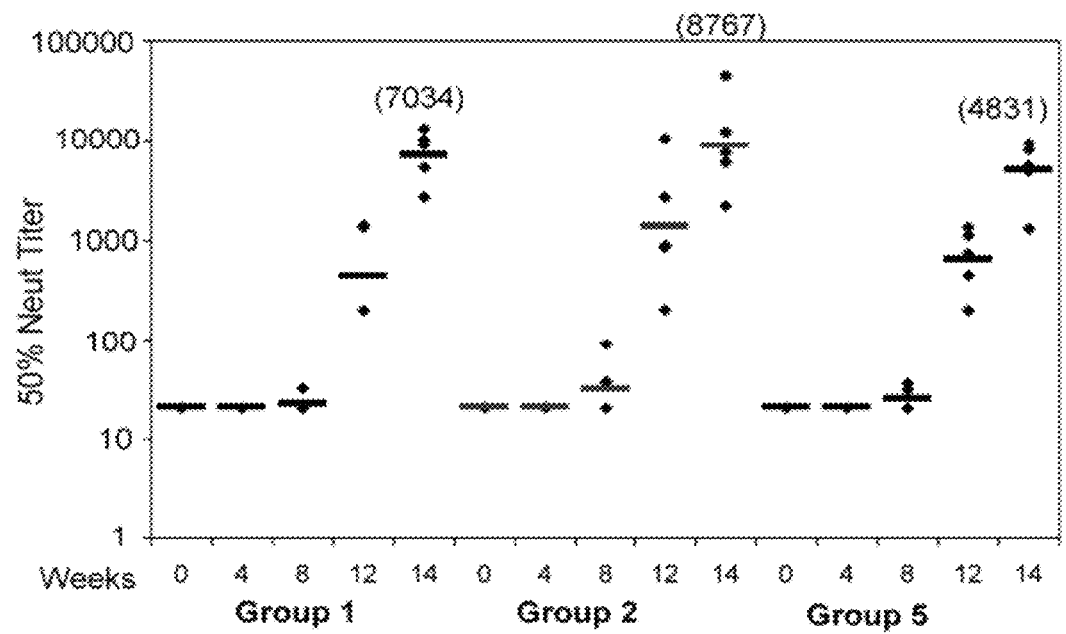

[a]Formalin-treatment = formalin/glycine treated for 2 days at 25° C.; mutant toxin was not cytotoxic and retained binding to all mutant toxin-specific monoclonal antibodies tested
[b]EDC-treatment = EDC/NHS treated for 4 hrs at 30° C.; mutant toxin was not cytotoxic and retained binding to all mutant toxin-specific monoclonal antibodies tested
[c]aluminum ion concentration = 0.5 mg/mL Results: There were no adverse events in the mice following each administration of the vaccine candidates. As illustrated in FIG. 11, after two doses of chemically inactivated genetic mutant toxins, the anti-toxin A neutralizing antibodies (Groups 3-5) were boosted to titers between 3 and 4 log$_{10}$ while the anti-toxin B neutralizing antibodies (Groups 1-2, 5) remained low to undetectable, which is consistent with the data from the mouse study described above (FIG. 10). Anti-toxin B neutralizing antibodies boosted to 2-3 log$_{10}$ in groups 1, 2, and 5 following the third dose (week 12 titers) and reached their peak two weeks following the fourth dose (week 14 titers). The anti-toxin A neutralizing antibody titers in groups 3-5 increased slightly following the third (week 12 titers) and fourth immunizations (week 14 titers).

Example 27

Hamster Immunogenicity Study: ham C. difficile 2010-02:

The purpose of this study was to assess immunogenicity and protective potential of C. difficile triple mutant and chemically inactivated mutant toxins A and B in the Syrian golden hamster model. The Syrian golden hamster model represents the best available challenge model for simulating human CDAD. The same batches of mutant toxins A and B used in mouse study mu C. difficile 2010-07 were used in this study. As a control, one group was given mutant toxins without aluminum-containing adjuvant.

Groups of 5 Syrian golden hamsters were immunized intramuscularly with 10 µg of an immunogen according to Table 14.

TABLE 14

Testing Chemically Inactivated Mutant Toxins A and B (SEQ ID NOs: 4 and 6, respectively) in Hamsters (hamC. difficile2010-02)

| Group | Immunogen | Dose | No. | Route | Schedule |
|---|---|---|---|---|---|
| 1 | Formalin-Inactivated[a] Mutant toxins A + B (SEQ ID NOs: 4 and 6) in AlPO$_4$[c] | 10 µg each | 5 | IM | Prime wk 0, Boost wks 4, 8, 12 |
| 2 | Formalin-Inactivated Mutant toxins A + B (SEQ ID NOs: 4 and 6) in PBS (no adjuvant) | 10 µg each | 5 | IM | Prime wk 0, Boost wks 4, 8, 12 |
| 3 | EDC-Inactivated[b] Mutant toxins A + B (SEQ ID NOs: 4 and 6) in AlPO$_4$[c] | 10 µg each | 5 | IM | Prime wk 0, Boost wks 4, 8, 12 |
| 4 | List Biological toxoid in AlPO$_4$[c] | 10 µg each | 5 | IM | Prime wk 0, Boost wks 4, 8, 12 |

Figure 12:
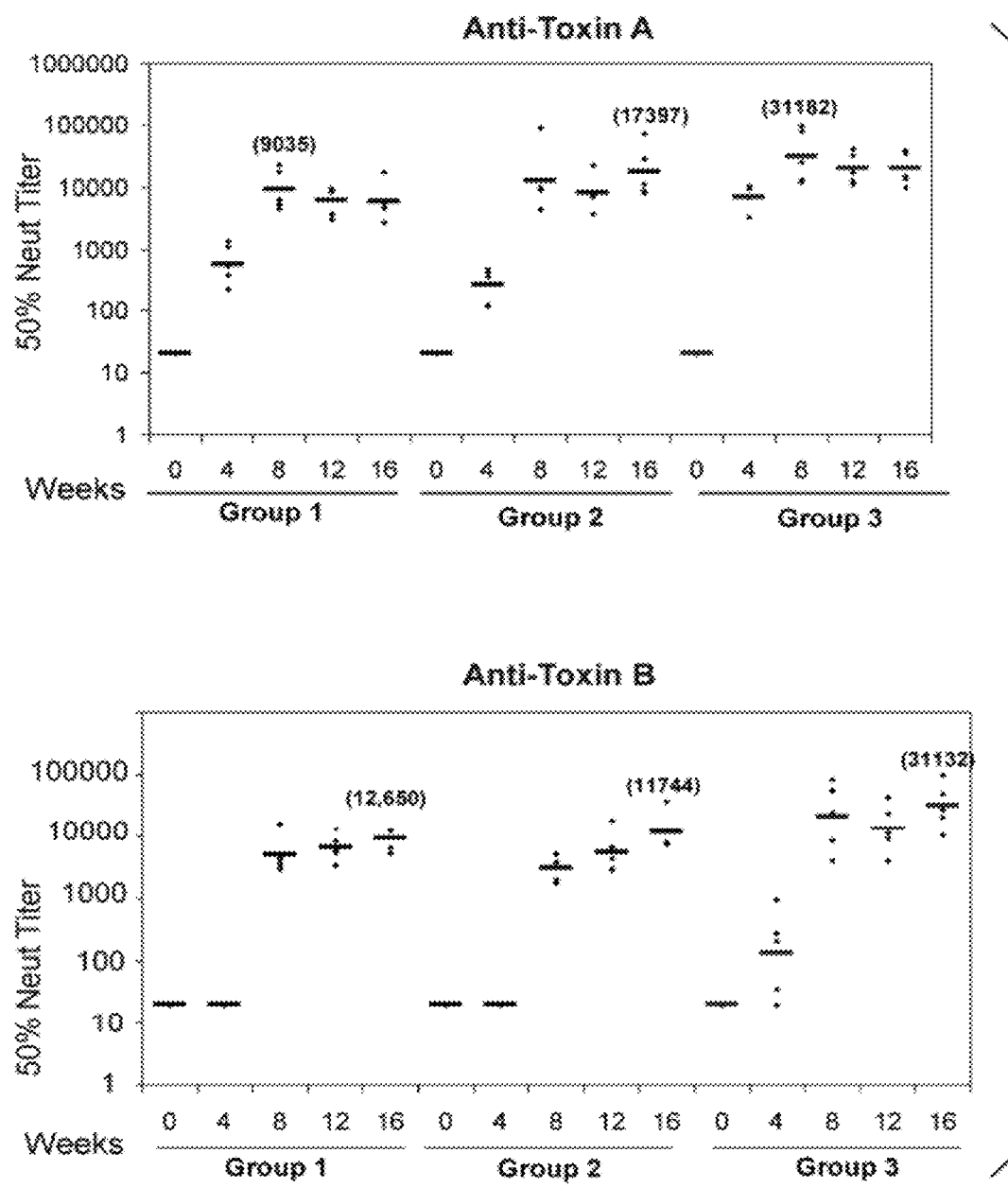
FIG. 12: Graph showing neutralizing antibody responses against toxins A and B in hamsters after four immunizations as described in Example 27 (study ham*C. difficile*2010-02)

[a]Formalin-treatment = formalin/glycine treated for 2 days at 25° C.; Mutant toxin was not cytotoxic and retained binding to all mutant toxin-specific monoclonal antibodies tested
[b]EDC-treatment = EDC/NHS treated for 4 hrs at 30° C.; Mutant toxin was not cytotoxic and retained binding to all mutant toxin-specific monoclonal antibodies tested
[c]aluminum ion concentration = 0.5 mg/mL 1. Animals: 15 Syrian golden hamsters, female, 6-8 weeks old/100-130 g each.
2. Vaccination: IM, 0.05 ml each, according to above schedule. Toxoids will be provided by Process Development and will be formulated in AlPO4 diluent by the Formulations Group. Group 2 will serve as a non-adjuvanted control group.
3. Bleed: All hamsters will be bled at weeks 0, 4, 8, and 12, just prior to each immunization.
4. Serum sample analysis: Neutralization assay Results: There were no adverse events observed following immunization with the mutant toxins. As illustrated in FIG. 12, after a single dose of mutant toxins, the anti-toxin A neutralizing responses were between 2-3 log$_{10}$ for the formalin-inactivated mutant toxins (Groups 1-2) and between 3-4 log$_{10}$ for the EDC-inactivated mutant toxins (Group 3). After the second dose, anti-toxin A antibodies boosted in all three groups. Anti-toxin A antibodies in all three groups did not appear to increase after the third dose. A similar result was observed after the fourth immunization, where an increase in titer was observed in the formalin-inactivated group that did not contain the aluminum adjuvant (Group 2).

The anti-toxin B neutralizing responses were undetectable in the formalin-inactivated mutant toxins groups (Groups 1-2) and were just over 2 log$_{10}$ for the EDC-inactivated mutant toxins (Group 3) after a single dose. After the second dose, anti-toxin B neutralizing antibody titers in the two formalin-inactivated groups (Groups 1-2) increased to 3-4 log$_{10}$ while those in the EDC-inactivated group (Group 3) increased to 4-5 log$_{10}$. For all three groups, increases in anti-toxin B neutralizing antibody titers were observed after the third and/or fourth doses, with all groups reaching a peak titer at week 16 (after the last dose). See FIG. 12.

In FIG. 13, the level of neutralizing antibody responses against chemically inactivated genetic mutant toxins (FIG. 12) was compared to those elicited by List Biological Laboratories, Inc. (Campbell, Calif.) (also referred herein as "List Bio" or "List Biologicals") toxoids (i.e., toxoids purchased from List Biological Laboratories were prepared by formalin inactivation of wild type toxins; control reagent used to establish the hamster challenge model).

As used herein, "FI" in figures and tables refers to formalin/glycine treatment of the toxins, 2 days at 25° C., unless otherwise stated. As used herein, "EI" in figures and tables refers to EDC/NHS treatment for 4 hours at 30° C., unless otherwise stated. In FIG. 13, 5 hamster animals were treated with the respective mutant toxin composition, whereas 11 hamster animals were treated with the toxoid purchased from List Biological.

Figure 13A:
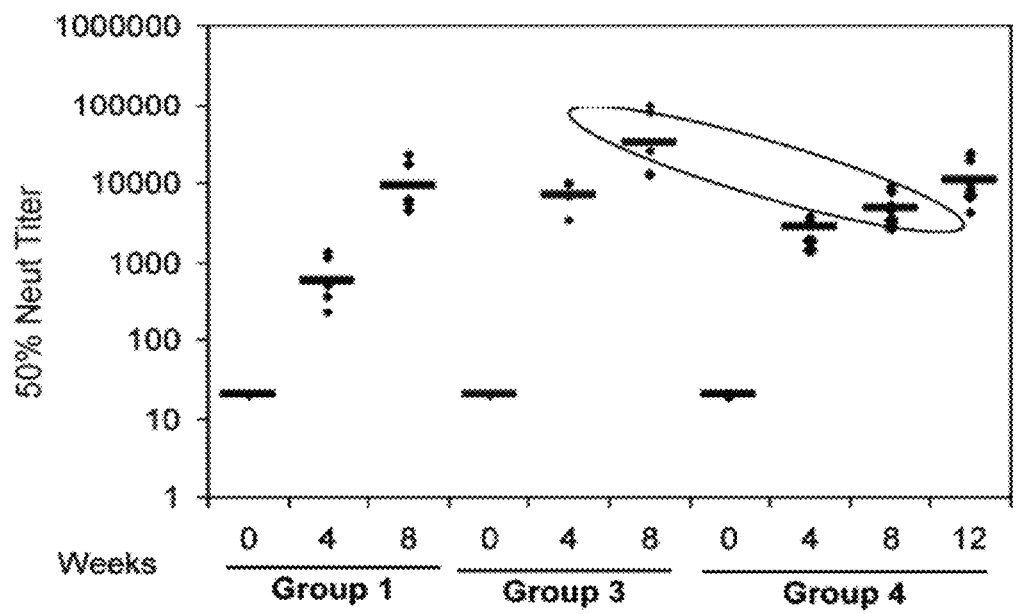
FIG. 13: Graph showing neutralizing antibody responses in hamsters after vaccination with chemically inactivated genetic mutant toxins and List Biological toxoids, as described in Example 27 (study ham*C. difficile*2010-02).
Figure 13B:
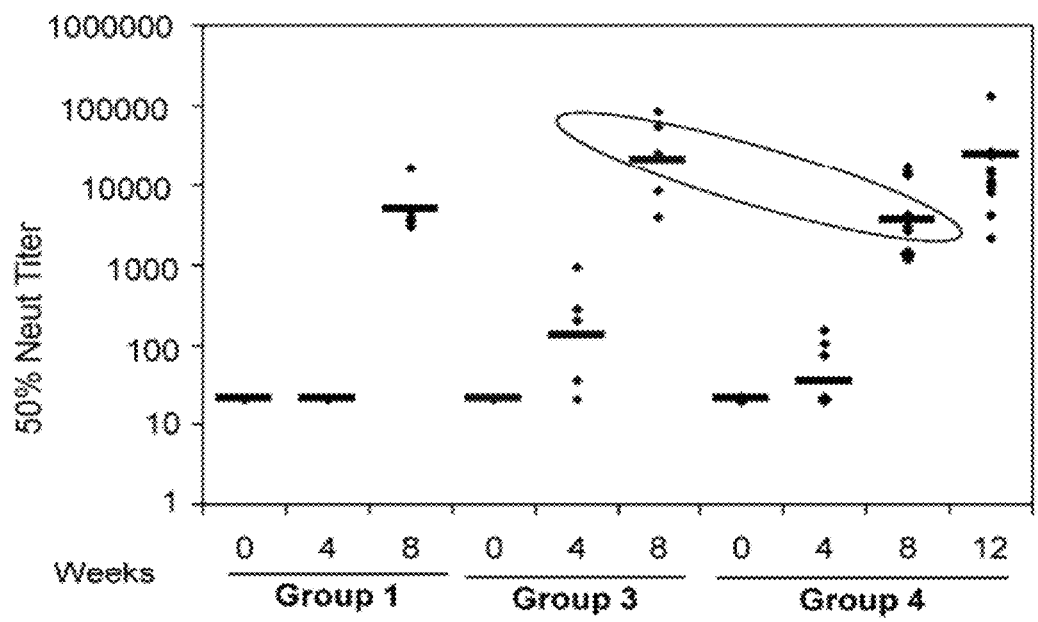
Figure 14:
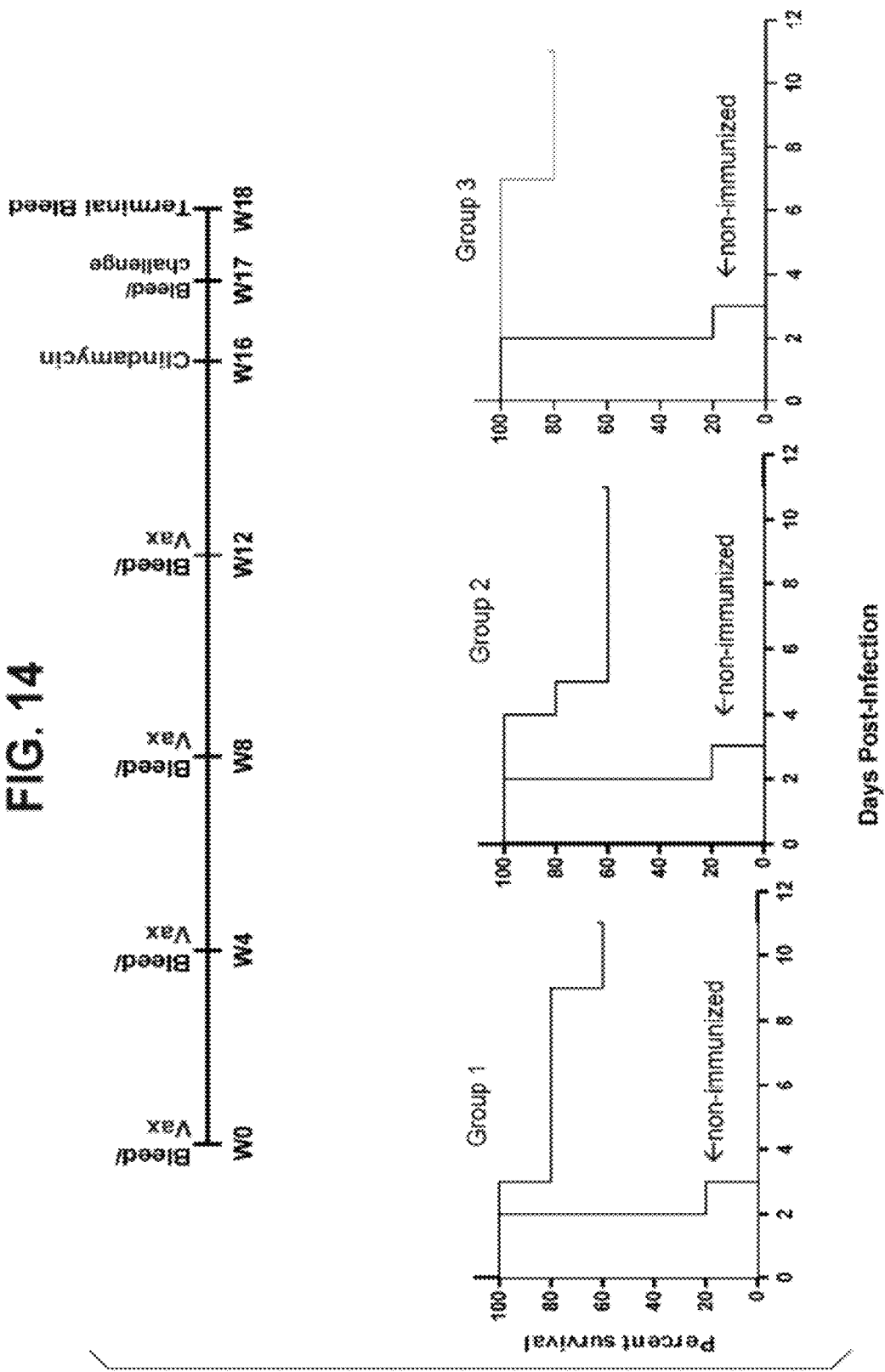
FIG. 14: Survival curves for three immunized groups of hamsters as compared to the non-immunized controls, described in Example 28 (study ham*C. difficile*2010-02, continued).
Figure 16A:
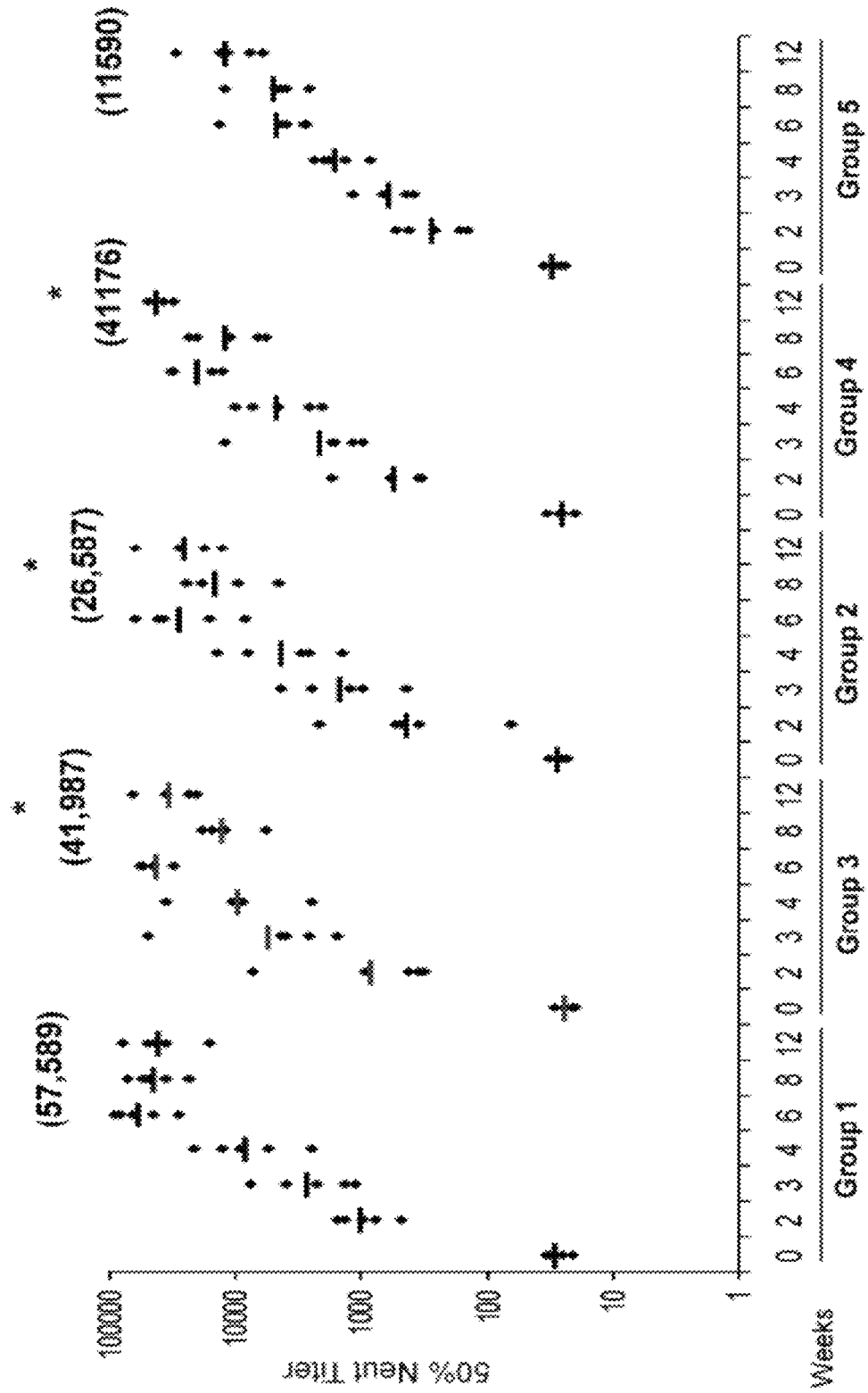

The data in FIG. 13 shows that, in hamsters administered according to Table 14, the respective neutralizing antibody titers against toxin A (FIG. 13A) and toxin B (FIG. 13B) induced by the immunogenic composition including EDC inactivated mutant toxins after two doses is higher than the respective neutralizing antibody titers elicited by the List Biologicals toxoids.

Example 28

Hamster Immunogenicity Study: *C. difficile* ham2010-02 (continued)

To assess protective efficacy of the mutant toxins, immunized hamsters, along with one control group of non-immunized animals, were first given an oral dose of clindamycin antibiotic (30 mg/kg) to disrupt normal intestinal flora. After five days, the hamsters were challenged with an oral dose of wild type *C. difficile* spores (630 strain, 100 cfu per animal). Animals were monitored daily for eleven days post-challenge for signs of CDAD, which in hamsters is known as wet tail. Using a system of clinical scoring a number of different parameters, animals determined to have severe CDAD were euthanized. The parameters included activity following stimulation, dehydration, excrement, temperature, and weight, etc., which are known in the art.

At day 11, the study was terminated and all surviving animals were euthanized. FIG. 14 shows the survival curves for each of the three immunized groups (Groups 1-3, according to Table 14) as compared to the non-immunized controls. As can be seen, the non-immunized animals all developed severe CDAD and required euthanasia between days 1-3 post challenge (0% survival). Both groups administered with formalin-inactivated mutant toxin had 60% survival curves, with animals not requiring euthanasia until day 3 (Group 1) or day 4 (Group 2). The group administered with EDC-inactivated mutant toxin had an 80% survival curve, with 1 (out of 5) animal requiring euthanasia on day 7. Accordingly, the hamsters were protected from lethal challenge with *C. difficile* spores.

Example 29

Hamster immunogenicity study: ham *C. difficile* 2010-03

Immunogenicity of genetic and chemically-inactivated *C. difficile* mutant toxins The purpose of this study was to assess immunogenicity of non-adjuvanted *C. difficile* triple mutant and chemically inactivated mutant toxins A and B (SEQ ID NOs: 4 and 6, respectively) in the Syrian golden hamster model. The same batches of mutant toxins A and B (SEQ ID NOs: 4 and 6, respectively) used in mouse study mu *C. difficile* 2010-07 were used in this study. As a control, one group (Group 1) was given a phosphate-buffered saline as placebo.

Groups of five or ten Syrian golden hamsters were immunized with an immunogen according to Table 15. Animals were given three doses. In addition, animals were dosed every two weeks.

TABLE 15

Experimental Design of Hamster Immunization and Challenge

| Group | Immunogen | Dose | No. | Route | Schedule |
|---|---|---|---|---|---|
| 1 | Placebo (PBS buffer) | NA | 5 | NA | |
| 2 | Mutant toxin A + B (SEQ ID NOs: 4 and 6, respectively); Formalin-inactivated | 10 μg each | 10 | IM | Prime wk 0, Boost wks 2, 4 |
| 3 | Mutant toxin A + B (SEQ ID NOs: 4 and 6, respectively); EDC-Inactivated | 10 μg each | 10 | IM | Prime wk 0, Boost wks 2, 4 |
| 4 | Mutant toxin A + B (SEQ ID NOs: 4 and 6, respectively); genetic | 10 μg each | 10 | IM | Prime wk 0, Boost wks 2, 4 |

Results: See FIG. 15. No anti-toxin A or B antibodies were observed in the placebo control group. After one dose, anti-toxin A neutralizing antibodies were observed between 2-3 $\log_{10}$ for the formalin-inactivated (Group 2) and genetic mutant toxin (Group 4) groups and between 3-4 $\log_{10}$ for the EDC-inactivated group (Group 3). Anti-toxin A neutralizing antibodies increased in each of these groups (2-4) after the second immunization with the relevant mutant toxins (compare titers at week 2 to week 3 in FIG. 15). After the third dose of mutant toxins (given at week 4), anti-toxin A neutralizing antibody titers in Groups 2-4 increased compared to their week 4 titers.

Anti-toxin B neutralizing antibodies were detectable after the second dose, wherein the formalin-inactivated (Group 2) and EDC-inactivated (Group 3) anti-toxin B neutralizing antibodies increased to between 3-4 $\log_{10}$ and to between 2-3 $\log_{10}$ for the genetic triple mutant (Group 4). Following the third immunization (week 4), the anti-toxin B neutralizing antibody titers boosted to between 3-4 $\log_{10}$ for the formalin-inactivated mutant toxins (Group 2) and genetic mutant toxins (Group 4) and between 4-5 $\log_{10}$ for the EDC-inactivated mutant toxins (Group 3).

For both anti-toxin A and anti-toxin B neutralizing antibodies, peak titers were observed at week 6 (post-dose 3) for all vaccinated groups (Groups 2-4).

Assessment of Immunogenic Compositions Adjuvanted with Alhydrogel/CpG or ISCOMATRIX Hamsters immunized with an immunogenic composition including a chemically inactivated mutant toxin formulated with Alhydrogel, ISCOMATRIX, or Alhydrogel/CpG24555 (Alh/CpG) developed robust neutralizing antitoxin antisera. It was observed that peak antitoxin A and antitoxin B responses were 2-3-fold higher and statistically significant in groups immunized with mutant toxins formulated in Alh/CpG or ISCOMATRIX when compared to vaccine formulated with Alhydrogel alone. See Table 32 showing 50% neutralization titers. Hamsters (n=10/group) were immunized IM at 0, 2, and 4 weeks with 10 μg each mutant toxin A drug substance and mutant toxin B drug substance formulated with 100 μg of Alhydrogel, or 200 μg of CpG 24555+100 μg of Alhydrogel, or 10 U of ISCOMATRIX. Sera were collected at each time point and analyzed in the toxin neutralization assay for functional antitoxin activity. Geometric mean titers are provided in Table 32. Asterisks (*) indicate statistical significance ($p<0.05$) when compared to titers in the Alhydrogel group.

TABLE 32

Immunogenicity of Adjuvanted Mutant Toxin Drug Substances in Hamsters 50% Neutralization Titer

| | Week 0 | Week 1 | Week 2 | Week 3 | Week 4 | Week 6 |
|---|---|---|---|---|---|---|
| Antitoxin A | | | | | | |
| Alhydrogel Titer: | 10 | 26 | 88 | 7425 | 6128 | 15965 |
| Alh/CpG Titer: | 10 | 103 | *688 | *34572 | *23028 | *62203 |
| ISCOMATRIX Titer: | 10 | 27 | *246 | *12375 | 8566 | *36244 |
| Antitoxin B | | | | | | |
| Alhydrogel Titer: | 10 | 15 | 10 | 218 | 1964 | 7703 |
| Alh/CpG Titer: | 10 | 10 | 18 | *5550 | *5212 | *59232 |
| ISCOMATRIX Titer: | 10 | 12 | 12 | *7412 | *15311 | *92927 |

Protective efficacy of the immunogenic composition including mutant toxin drug substances formulated with these adjuvants was tested. Hamsters were immunized and were given oral clindamycin (30 mg/kg) on week 5 and challenged according to the method described above. One group of unimmunized hamsters (n=5) was included as a control. Increased efficacy was observed in hamsters immunized with mutant toxin drug substances adjuvanted with either Alh/CpG or ISCOMATRIX (100% survival) as compared to Alhydrogel alone (70% survival). Accordingly, the hamsters were protected from lethal challenge with *C. difficile* spores.

Example 30

*Clostridium difficile* Vaccination in Cynomolgus Macaques

The purpose of this study was to test the immunogenicity of low and high doses of EDC-Inactivated and Formalin-Inactivated *C. difficile* mutant toxins in cynomolgus macaques. All mutant toxins were formulated in ISCOMATRIX® as an adjuvant except for one group, which served as the unadjuvanted control (Group 5).

TABLE 16

Immunization of Cynomolgus Macaques

| Group | Immunogen | Number | Dose | Route | Schedule |
|---|---|---|---|---|---|
| 1 | FI-Mutant toxins A + B (ISCOMATRIX) | 5 | 10 μg each | IM | Prime wk 0, Boost wks 2, 4 |
| 2 | FI-Mutant toxins A + B (ISCOMATRIX) | 5 | 100 μg each | IM | Prime wk 0, Boost wks 2, 4 |
| 3 | EI-Mutant toxins A + B (ISCOMATRIX) | 5 | 10 μg each | IM | Prime wk 0, Boost wks 2, 4 |
| 4 | EI-Mutant toxins A + B (ISCOMATRIX) | 5 | 100 μg each | IM | Prime wk 0, Boost wks 2, 4 |
| 5 | EI-Mutant toxins A + B (no adjuvant) | 5 | 100 μg each | IM | Prime wk 0, Boost wks 2, 4 |

TABLE 16-continued

Animals: 25 cynomolgus macaques

The asterisk, "*", in FIG. 16 refers to having only 4 cynos in the group for week 12, one cyno in the group was terminally bled week at 8

Vaccination: IM, 0.5 mL per dose, at weeks 0, 2, and 4. Mutant toxin compositions were prepared as described above. The mutant toxin compositions were formulated in ISCOMATRIX, except Group 5 was formulated in buffer without adjuvant.

Bleed: Weeks −2, 0, 2, 3, 4, 6, 8, and 12. Euthanasia and terminal bleeds on animals with highest *C. difficile* titers at week 8.

Serum sample analysis: Protein ELISA and Neutralization assays

Results: FIG. 16 shows the anti-toxin neutralizing antibody responses in these animals at weeks 0, 2, 3, 4, 6, 8, and 12. Anti-toxin A titers were between 2-3 $\log_{10}$ for all five groups after a single dose (week 2 titers). These titers boosted after each subsequent dose for each group. In these animals, there was no drop in titer between weeks 3 and 4. For all groups, the peak titers were between 4-5 $\log_{10}$. At all time points, the group without ISCOMATRIX adjuvant (Group 5) had the lowest titers, indicating the utility of ISCOMATRIX at boosting the immune responses. The no-adjuvant control group (Group 5) reached peak titers at week 12, as did the group immunized with the high dose of EDC-inactivated mutant toxins (Group 4); all other groups reached peak titers at week 6, two weeks after the last dose. The titers in all groups boosted after the second dose (week 3 time point). As with the anti-toxin A responses, the anti-toxin B responses did not decrease from week 3 to week 4. After the third dose (week 6 time point), the anti-toxin B neutralizing antibody titers in all groups were between 3-4 $\log_{10}$, except in the low dose formalin-inactivated group (Group 1) and the high dose EDC-inactivated group (Group 4), both of which had titers just >4 $\log_{10}$. The peak titers were observed at week 12 for all groups except the low dose EDC-inactivated group (Group 3), which had peak titers at week 8. All groups had peak titers >4 $\log_{10}$.

Example 31

Monoclonal Antibodies Production

Although toxins A and B share a lot of structural homology, the neutralizing activities of the antibodies were found to be toxin-specific. In this invention, several antibodies were identified that are specific to individual toxin, and directed to various epitopes and functional domains, and have high affinity and potent neutralizing activity toward native toxins. Antibodies were isolated from mice that were immunized with either a commercially available formalin inactivated (FI)-mutant toxin or recombinant holo-mutant toxin (SEQ ID NOs: 4 and 6) rendered non-toxic by introducing specific mutations in its catalytic site for producing toxin A and B mAb, respectively. Epitope mapping of the antibodies showed that the vast majority of the mAb against toxin A (49 out of 52) were directed to the non-catalytic C terminal domain of the toxin.

Monoclonals against toxin B were targeted to three domains of the protein. Out of a total of 17 toxin B specific mAb, 6 were specific to N-terminus (e.g., amino acids 1-543 of a wild-type *C. difficile* TcdB, such as 630), 6 to C-terminus (e.g., amino acids 1834-2366 of a wild-type *C. difficile* TcdB, such as 630) and 5 to mid-translocation domain (e.g., amino acids 799-1833 of a wild-type *C. difficile* TcdB, such as 630). The approach of using mutant *C. difficile* toxins (e.g., SEQ ID NO: 4 and 6) as immunizing antigens thus offers a key advantage of presenting most, if not all, antigenic epitopes as compared to the formalin inactivation process that tend to adversely affect the antigenic structure of the mutant toxin.

Example 32

Characterization of Toxin A mAb, A3-25, which Includes a Variable Light Chain Having the Amino Acid Sequence of SEQ ID NO: 36 and a Variable Heavy Chain Having the Amino Acid Sequence of SEQ ID NO: 37

The mAb A3-25 was of particular interest since this antibody defied all attempts to define its immunoglobulin (Ig) isotyping using the commonly available isotyping kits for IgG, IgM and IgA. Further analysis by western blot using Ig H-chain specific antisera showed that the A3-25 is of IgE isotype, a rare event in mAb production. This was further confirmed by the nucleotide sequencing of mRNA isolated from A3-25 hybridoma cells. The amino acid sequences deduced from the nucleotide sequences of the variable regions of H- and L-chain of A3-25 are shown in FIG. 17.

In order to further evaluate the A3-25 mAb in animal model for *C difficile* infection and disease, its Ig isotype was changed to murine IgG1 by molecular grafting of the variable region of ε H chain onto the murine γ heavy chain according to the published methods.

Example 33

Neutralizing Ability and Epitope Mapping of Toxin Specific Antibodies

Further, in an effort to identify functional/neutralizing antibodies, all monoclonals were evaluated for the ability to neutralize wild type toxins in a standard cytopathic effect (CPE) assay or in a more stringent and quantitative assay based on measurement of ATP as cell viability indicator.

Out of a total of 52 toxin A specific antibodies, four mAb (A3-25, A65-33, A60-22 and A80-29 (Table 17 and FIG. 18) exhibited varied levels of neutralizing activity. BiaCore competitive binding assay and hemagglutination inhibition (HI) assays were performed to map the antibody epitopes. Results indicated that these antibodies may be targeted to different epitopes of the toxin A protein (Table 17). To further identify the location of binding sites on the protein, the antibodies were individually evaluated in western blot or dot blot assays using toxin fragments of known sequences. All 4 neutralizing mAb were found to be directed to the C-terminus region of the toxin.

Figure 19:
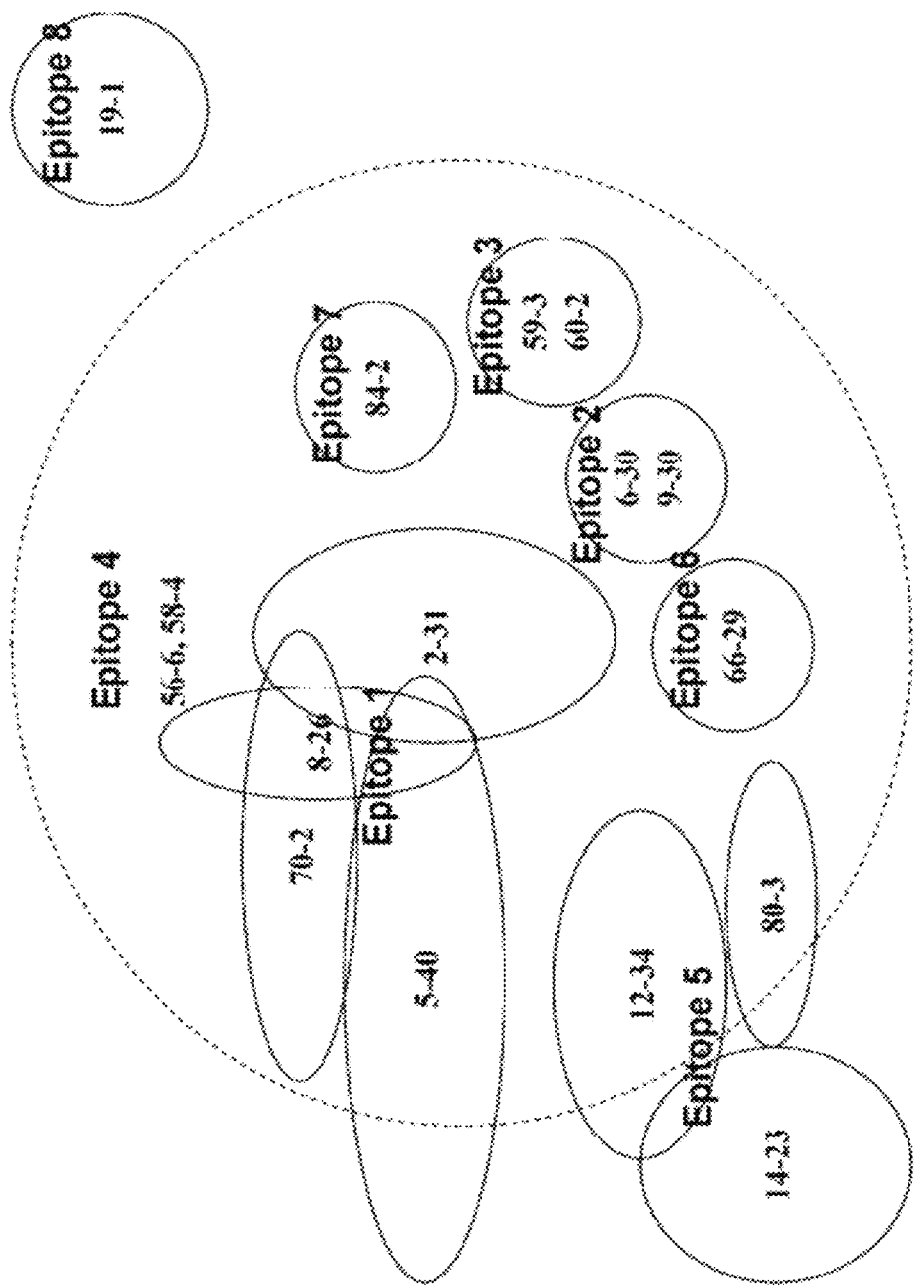
FIG. 19: Mapping of 8 epitope groups of toxin B mAbs by BiaCore

From a total of 17 toxin B specific antibodies, 9 were found to be neutralizing. Of the nine neutralizing mAb, six of them were directed to the N-terminus and the other three to the translocation domain of the B toxin (Table 18). Based on the Biacore competitive binding assay, the nine neutralizing monoclonal antibodies may be grouped into four epitope groups as shown in FIG. 19.

TABLE 17

Characteristics of Selected Toxin A mAb

| Epitope Group (Biacore) | mAb # | Neutralizing activity | Hemagglutination Inhibition | Binding Specificity | Ig Isotype |
|---|---|---|---|---|---|
| 1 | A3-25 | + | − | C-teriminal | IgE, κ |
| 2 | A65-33 | + | − | C-teriminal | IgG2a, κ |
| 3 | A80-29 | + | + | C-teriminal | IgG1, κ |

TABLE 17-continued

Characteristics of Selected Toxin A mAb

| Epitope Group (Biacore) | mAb # | Neutralizing activity | Hemagglutination Inhibition | Binding Specificity | Ig Isotype |
|---|---|---|---|---|---|
| ND | A60-22 | + | + | C-teriminal | IgG1, κ |
| 4 | A64-6 | − | − | In progress | IgG1, κ |
|  | A50-10 | − | − | C-teriminal | IgG1, κ |
|  | A56-33 | − | − | In progress | IgG1, κ |
| ND | A1 | − | − | N-terminal | IgG1, κ |

TABLE 18

Characteristics of Selected Toxin B mAb

| Epitope Group (Biacore) | mAb # | Neutralizing activity | Binding Specificity | Ig isotype |
|---|---|---|---|---|
| 1 | B2-31 | + | N-terminal | IgG1, κ |
|  | B5-40 |  |  | IgG1, κ |
|  | B8-26 |  |  | IgG1, κ |
|  | B70-2 |  |  | IgG1, κ |
| 2 | B6-30 | + | N-terminal | IgG1, κ |
|  | B9-30 |  |  | IgG1, κ |
| 3 | B59-3 | + | Translocation domain | IgG1, κ |
|  | B60-2 |  |  | IgG1, κ |
| 4 | B56-6 | + | Translocation domain | IgG1, κ |
|  | B58-4 | − |  | IgG1, κ |
| 5 | B12-34 | − | C-terminal | IgG1, κ |
|  | B14-23 |  |  | IgG1, κ |
|  | B80-3 |  |  | IgG1, κ |
| 6 | B66-29 | − | C-terminal | IgG1, κ |
| 7 | B84-3 | − | C-terminal | IgG1, κ |

Example 34

Figure 18:
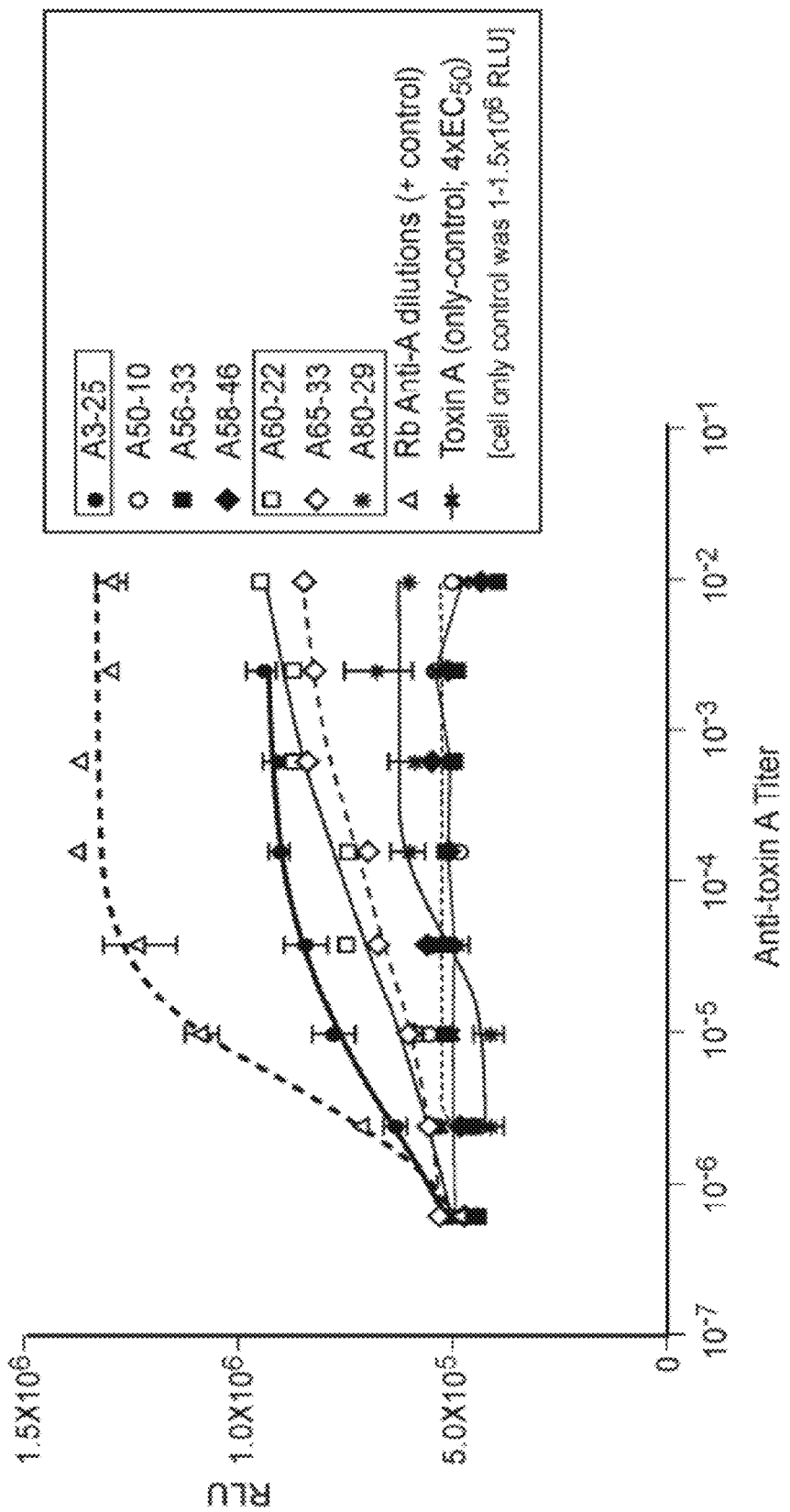
FIG. 18: Graph showing titration of individual toxin A monoclonal antibodies in the toxin neutralization assay using ATP levels (quantified by relative light units—RLU) as an indicator of cell viability. In comparison to the toxin ($4 \times EC_{50}$) control, mAbs A80-29, A65-33, A60-22 and A3-25 had increasing neutralizing effects on toxin A with concentration but not to the level of the positive rabbit anti-toxin A control. mAbs A50-10, A56-33, and A58-46 did not neutralize toxin A. The cell only control was $1-1.5 \times 10^6$ RLUs.
Figure 20A:
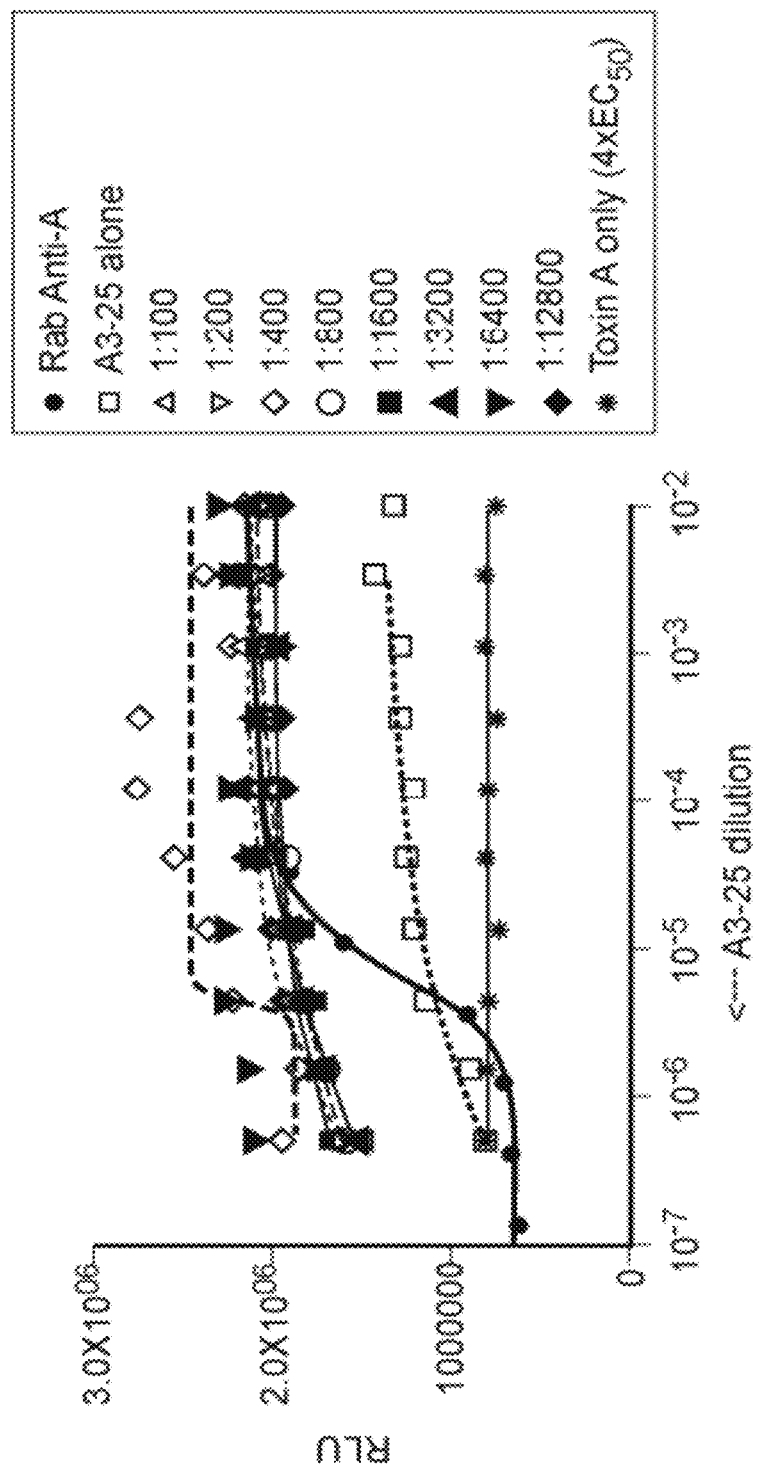

Identification of Novel Toxin A Antibodies Combinations with Significantly Enhanced Neutralizing Activity The four toxin A mAb (A3-25, A65-33, A60-22 and A80-29) showed incomplete or partial neutralization of toxin A when tested individually in the ATP based neutralization assay. The mAb A3-25 was the most potent antibody and the other three were less neutralizing with A80-29 barely above background (FIG. 18). However, when A3-25 was combined with either one of the other three mAbs, a synergistic effect in neutralization was observed in all three combinations which was far greater than the sum total of neutralization of individual antibodies as shown in FIG. 20A-C. In addition, all three combinations exhibited complete neutralization capability normally observed with anti-toxin A polyclonal antibodies.

Example 35

Identification of Novel Toxin B Antibodies Combinations Showing Significantly Enhanced Neutralizing Activity We also observed synergistic neutralization with the Toxin B mAbs from the different epitope groups identified by BiaCore analysis. Toxin B mAb B8-26, the most dominant mAb of group 1, was combined with multiple mAbs from group 3. The combinations were evaluated in a toxin B specific neutralization assay and the results are shown in FIG. 21 and Table 19.

TABLE 19

Neutralization of Toxin B with mAbs

| mAb | Neut titer | |
|---|---|---|
| | CPE | ATP |
| B8-26 alone | 20,480 | 5,000 |
| B59-3 alone | 320 | 120 |
| B60-2 alone | 320 | 80 |
| B8-26 + B59-3 | 655,360 | ~60,000 |
| B8-26 + B60-2 | 327,680 | nd | nd, not done

The synergistic neutralizing effect was observed when B8-26 was combined with an epitope group 3 mAb (FIG. 21B), but not any other mAb (data not shown).

Example 36

In Vitro Screening by mAB for Safe and Efficacious Mutant Toxin Compositions Genetic mutant toxins A and B of *C difficile* (e.g., SEQ ID NO: 4 and 6) generated via genetic engineering showed residual cytotoxicity using an in vitro cytotoxicity assay. Although we have achieved a ~4 log reduction in cytotoxicity for each mutant toxin *C. difficile* toxin (Table 20), further chemical inactivation of the mutant toxins, such as with formalin treatment was preferred. However, chemical inactivation treatments may be harsh and may adversely affect key antigenic epitopes of these toxins or mutant toxins.

TABLE 20

A Comparison of In Vitro Cytotoxicity of WT Toxin, Triple Mutant Toxin, and Formalin-Inactivated (FI, from List Biological) WT toxins (List Biological, commercial)

| Tcd | Source/treatment | $EC_{50}$ ng/mL | Fold Reduction in Cytotoxicity |
|---|---|---|---|
| TcdA | | | |
| Toxin A (SEQ ID NO: 1) | WT | 0.92 | 1 |
| Mutant toxin A (SEQ ID NO: 4) | Triple mutant | 8600 | 9348 |
| Toxoid A (FI) | Formalin treated, commercial | >20,000 | >21,739 |
| TcdB | | | |
| Toxin B (SEQ ID NO: 2) | WT | 0.009 | 1 |
| Mutant toxin B (SEQ ID NO: 6) | Triple mutant | 74 | 8222 |
| Toxoid B (FI) | Formalin treated, commercial | 4300 | 477,778 |

For bioprocess optimization, a statistical design of experiment (DOE) was performed for the chemical inactivation of triple mutant Tcd A and B (1 mg/mL) using formalin and EDC/NHS treatment. To optimize formalin inactivation of triple mutant TcdA, we varied concentrations of formalin/glycine (20-40 mM), pH (6.5-7.5), and temperature (25-40° C.). For triple mutant TcdB, we varied the formalin/glycine concentration from 2 to 80 mM and the temperature and pH were 25° C. and 7.0 respectively. The incubation time for all formalin treatments was 24 hours. For the formalin inactivation, "40/40" in Tables 21 and 23 represents the concentration of formalin and glycine used in the reaction. For EDC/NHS treatment, we varied the concentrations of EDC/NHS from 0.25 to 2.5 mg/mg of triple mutant TcdA and from 0.125 to 2.5 mg/mg of triple mutant TcdB and incubated for four hours at 25° C. At the end of the reactions, all samples were desalted in 10 mM phosphate, pH 7.0. After purification, the treated Tcds were analyzed for residual cytotoxicity and mAb recognition of epitopes by dot-blot analysis. The goal was to identify treatment conditions that reduce cytotoxicity to the desired level ($EC_{50}$>1000 µg/mL) without negatively impacting epitopes recognized by a panel of neutralizing mAbs (++++ or +++). The treatment conditions (marked with a check mark "✓" in Tables 21-24) yielded potentially safe and efficacious immunogenic compositions that retained reactivity to at least four neutralizing mAbs while exhibiting 6-8 $log_{10}$ reduction in cytotoxicity, relative to the respective wild-type toxin cytotoxicity. Select results are illustrated in Tables 21 to 24. Additional data from varying treatment conditions on the triple mutant toxins and the data from in vitro cytotoxicity and toxin neutralization assays are shown in Table 33 and Table 34. See also, for example, Examples 20 and 21 above, which provide further details regarding preferred crosslinking treatment conditions of the mutant toxins.

TABLE 21

Cytotoxicity and Neutralizing mAb Reactivity of Formalin-inactivated Triple Mutant TcdA (SEQ ID NO: 4)

| | | Reactivity with mAb (dot blot, non-denaturing conditions) | | | | | |
|---|---|---|---|---|---|---|---|
| | | | | | | C-terminal (neut) | |
| Chemical inactivation reaction conditions on Triple Mutant TcdA | CPE µg/mL | N-terminal Mab#6 | Translocation Domain Mab# 102 | A80-29 | A3-25 | A60-22 | A65-33 |
| 25° C., pH 6.5, 20/20 mM | 250 | ++++ | ++++ | ++++ | ++++ | ++++ | ++++ |
| 25° C., pH 6.5, 40/40 mM ✓ | >1000 | ++++ | ++++ | ++++ | ++++ | ++++ | ++++ |
| 25° C., pH 7.5, 40/40 mM ✓ | >1000 | ++++ | ++++ | ++++ | ++++ | ++++ | ++++ |
| 40° C., pH 6.5, 40/40 mM | >1000 | ++ | +++ | ++++ | ++++ | ++++ | ++++ |
| 40° C., pH 7.5, 40/40 mM | >1000 | ++ | ++ | ++++ | ++++ | ++++ | +++ |
| None, Triple mutant toxin A | 18.5-25 | ++++ | ++++ | ++++ | ++++ | ++++ | ++++ |
| FI Toxoid A (List Biological) | ND | − | − | ++ | ++ | +++ | + |

TABLE 22

Cytotoxicity and Neutralizing mAb Reactivity of EDC-inactivated Triple Mutant TcdA (SEQ ID NO: 4)

| Chemical inactivation reaction conditions on Triple Mutant TcdA | CPE µg/mL | N-terminal Mab#6 | Translocation Domain Mab# 102 | C-terminal (neut) A80-29 | A3-25 | A60-22 | A65-33 |
|---|---|---|---|---|---|---|---|
| 25° C., 0.25 mg/mg, 4 hr ✓ | >1000 | ++++ | ++++ | ++++ | ++++ | ++++ | ++++ |
| 25° C., 0.5 mg/mg, 4 hr ✓ | >1000 | ++++ | ++++ | ++++ | ++++ | ++++ | ++++ |
| 25° C., 1.25 mg/mg, 4 hr ✓ | >1000 | +++ | ++++ | ++++ | +++ | ++++ | ++++ |
| 25° C., 2.5 mg/mg, 4 hr ✓ | >1000 | +++ | ++++ | ++++ | +++ | ++++ | +++ |
| None, Triple mutant TcdA | 18.5-25 | ++++ | ++++ | ++++ | ++++ | ++++ | ++++ |
| FI Toxoid A (List Biological) | ND | − | − | ++ | ++ | +++ | + |

TABLE 23

Cytotoxicity and Neutralizing mAb Reactivity of Formalin-inactivated Triple Mutant TcdB (SEQ ID NO: 6)

| Chemical inactivation reaction conditions on Triple Mutant TcdB | CPE (µg/mL) | mAb # (N-terminal aa 1-543) B8-26 | B9-30 | mAb # (mid-/C-terminal aa 544-2366) B56-6 | B59-3 |
|---|---|---|---|---|---|
| 25° C., pH 7.0, 80/80 mM, 24 hr ✓ | >1000 | ++++ | ++++ | ++++ | +++ |
| 25° C., pH 7.0, 40/40 mM, 24 hr ✓ | >1000 | ++++ | ++++ | ++++ | ++++ |
| 25° C., pH 7.0, 10/10 mM, 24 hr | 15.6 | ++++ | ++++ | ++++ | ++++ |
| 25° C., pH 7.0, 2/2 mM, 24 hr | <0.98 | ++++ | ++++ | ++++ | ++++ |
| None, Triple mutant TcdB | 0.058 | ++++ | ++++ | ++++ | ++++ |
| FI Toxoid B (List Biological) | ND | +++ | +++ | +++ | ++ |

TABLE 24

Cytotoxicity and Neutralizing mAb Reactivity of EDC-inactivated Triple Mutant TcdB (SEQ ID NO: 6)

| Chemical inactivation reaction conditions on Triple Mutant TcdB | CPE (µg/mL) | mAb # (N-terminal aa 1-543) 8-26 B8-26 | 9-30 B9-30 | mAb # (mid-/C-terminal aa 544-2366) 56-6 B56-6 | 59-3 B59-3 |
|---|---|---|---|---|---|
| 25° C., 0.125 mg/mg, 4 hr | 3.9 | ++++ | ++++ | ++++ | ++++ |
| 25° C., 0.25 mg/mg, 4 hr | 250 | ++++ | ++++ | ++++ | ++++ |
| 25° C., 0.5 mg/ml, 4 hr ✓ | >1000 | ++++ | ++++ | ++++ | ++++ |
| 25° C., 1.25 mg/mg, 4 hr ✓ | >1000 | ++++ | +++ | +++ | +++ |
| 25° C., 2.5 mg/mg, 4 hr ✓ | >1000 | ++++ | +++ | +++ | +++ |
| None, Triple mutant TcdB | 0.058 | ++++ | ++++ | ++++ | ++++ |
| FI Toxoid B (List Biological) | ND | +++ | +++ | +++ | ++ |

TABLE 33

| Sample # | Mutant toxin A (SEQ ID NO: 4) Sample ID | Cyto Assay (EC50) CPE; 24 h µg/mL | CPE, 72 h µg/mL | Reactivity with mAb (dot blot, non-denaturing conditions) N-terminal Mab#6 | Translocation Domain Mab# 102 | C-terminal (neut) 80-29 | 3-25 | 60-22 | 65-33 |
|---|---|---|---|---|---|---|---|---|---|
| 1 | L44166-157A | >1000 | >1000 | ++++ | ++++ | ++++ | +++ | ++++ | ++++ |
| 2 | L44166-157B | >1000 | >1000 | +++ | ++++ | ++++ | +++ | ++++ | ++++ |
| 3 | L44166-157C | >1000 | >1000 | +++ | +++ | ++++ | +++ | ++++ | ++++ |
| 4 | L44166-157D | >1000 | >1000 | +++ | +++ | ++++ | +++ | ++++ | ++++ |
| 5 | L44905-160A | >1000 | >1000 | ++ | ++ | ++++ | ++ | ++++ | ++++ |
| 6 | L44166-166 | >1000 | >1000 | ++++ | ++++ | ++++ | ++++ | ++++ | ++++ |

TABLE 33-continued

| | | Cyto Assay | | Reactivity with mAb (dot blot, non-denaturing conditions) | | | | | |
|---|---|---|---|---|---|---|---|---|---|
| | Mutant toxin A (SEQ ID NO: | (EC50) CPE; | CPE, | N-terminal | Translocation Domain | C-terminal (neut) | | | |
| Sample # | 4) Sample ID | 24 h µg/mL | 72 h µg/mL | Mab#6 | Mab# 102 | 80-29 | 3-25 | 60-22 | 65-33 |
| 7 | L44905-170A | ND | >1000 | + | + | ++ | ++ | ++ | + |
| 8 | L44897-61 | >1000 | ND | +++ | ++ | ++++ | ++++ | ++++ | ++++ |
| 9 | L44897-63 | >1000 | ND | ++++ | +++ | ++++ | +++ | ++++ | ++++ |
| 10 | L44897-72 Tube#1 | 250 | ND | ++++ | ++++ | ++++ | ++++ | ++++ | ++++ |
| 11 | L44897-72 Tube#2 | >1000 | ND | ++++ | ++++ | ++++ | ++++ | ++++ | ++++ |
| 12 | L44897-72 Tube#3 | >1000 | ND | +++ | +++ | ++++ | ++++ | ++++ | ++++ |
| 13 | L44897-72 Tube#4 | >1000 | ND | +++ | ++++ | ++++ | ++++ | ++++ | ++++ |
| 14 | L44897-72 Tube#5 | >1000 | ND | +++ | ++++ | ++++ | ++++ | ++++ | ++++ |
| 15 | L44897-75 Tube#6 | >1000 | ND | +++ | ++++ | ++++ | ++++ | ++++ | ++++ |
| 16 | L44897-75 Tube#7 | >1000 | ND | ++++ | ++++ | ++++ | ++++ | ++++ | ++++ |
| 17 | L44897-75 Tube#8 | >1000 | ND | ++++ | ++++ | ++++ | ++++ | ++++ | ++++ |
| 18 | L44897-75 Tube#9 | >1000 | ND | ++ | +++ | ++++ | ++++ | ++++ | ++++ |
| 19 | L44897-75 Tube#10 | >1000 | ND | ++++ | ++++ | ++++ | ++++ | ++++ | ++++ |
| 20 | L44897-75 Tube#11 | >1000 | ND | ++ | ++ | ++++ | ++++ | ++++ | +++ |
| 21 | L44897-101 (pre-modification) TxA control | 23.4 | <7.8 | ++++ | ++++ | ++++ | ++++ | ++++ | ++++ |
| 22 | L44897-101, 2 hr | 187.5 | 155.9 | +++ | ++++ | ++++ | ++++ | ++++ | ++++ |
| 23 | L44897-101, 4 hr | 375 | 380.3 | +++ | ++++ | ++++ | ++++ | ++++ | ++++ |
| 24 | L44897-101, 6 hr | 500 | 429.6 | +++ | ++++ | ++++ | ++++ | ++++ | ++++ |
| 25 | L44897 102, 24 hr | >1000 | >1000 | ++ | ++++ | ++++ | ++++ | ++++ | ++++ |
| 26 | L44897-103, 51 hr | >1000 | >1000 | + | +++ | +++ | ++++ | ++++ | +++ |
| 27 | L44897-104, 74 hr | >1000 | >1000 | − | +++ | +++ | +++ | +++ | +++ |
| 28 | L44897-105, 120 hr | >1000 | >1000 | − | ++ | ++ | +++ | +++ | ++ |
| 29 | L44980-004 | >1000 | >1000 | ++++ | ++++ | ++++ | ++++ | ++++ | ++++ |
| 30 | Reaction #1 Week 0, 25 C | 750 ug/mL | ND | ND | ++ | ++ | +++ | +++ | ++ |
| 31 | Reaction #1 Week 1, 25 C | 375 ug/mL | ND | ND | +++ | +++ | +++ | +++ | +++ |
| 32 | Reaction #1 Week 2, 25 C | 375 ug/mL | ND | ND | +++ | +++ | +++ | +++ | +++ |
| 33 | Reaction #1 Week 3, 25 C | 375 ug/mL | ND | ND | +++ | +++ | +++ | +++ | +++ |
| 34 | Reaction #1 Week 4, 25 C | 250 ug/mL | ND | ND | +++ | +++ | +++ | +++ | +++ |
| 35 | Reaction #1 Week 3, 37 C | 93.8 ug/mL | ND | ND | ++++ | ++++ | ++++ | ++++ | ++++ |
| 36 | Reaction #2 Week 0, 25 C | 375 ug/mL | ND | ND | +++ | +++ | +++ | +++ | +++ |
| 37 | Reaction #2 Week 1, 25 C | 375 ug/mL | ND | ND | ++++ | ++++ | ++++ | ++++ | ++++ |
| 38 | Reaction #2 Week 2, 25 C | 750 ug/mL | ND | ND | ++ | ++ | ++ | +++ | ++ |
| 39 | Reaction #2 Week 3, 25 C | 250 ug/mL | ND | ND | +++ | +++ | +++ | ++++ | +++ |
| 40 | Reaction #2 Week 4, 25 C | 250 ug/mL | ND | ND | +++ | +++ | +++ | ++++ | +++ |
| 41 | Reaction #2 Week 3, 37 C | 187.5 ug/mL | ND | ND | +++ | +++ | ++++ | ++++ | +++ |
| 42 | TxA Control Week 3, 25 C | 18.8 ug/mL | ND | ND | ++++ | ++++ | ++++ | ++++ | ++++ |
| 43 | TxA Control Week 3, 37 C | 25 ug/mL | ND | ND | ++++ | ++++ | ++++ | ++++ | ++++ |
| 44 | L44897-116-6 29.5 hrs | >2000 ug/mL | ND | ND | ++ | ++ | ++ | +++ | ++ |

TABLE 33-continued

| | | Cyto Assay | | Reactivity with mAb (dot blot, non-denaturing conditions) | | | | | |
|---|---|---|---|---|---|---|---|---|---|
| | | | | N-terminal | Translocation Domain | C-terminal (neut) | | | |
| Sample # | Mutant toxin A (SEQ ID NO: 4) Sample ID | (EC50) CPE; 24 h µg/mL | CPE, 72 h µg/mL | Mab#6 | Mab# 102 | 80-29 | 3-25 | 60-22 | 65-33 |
| 45 | L44897-116-7 57.5 hrs | >2000 ug/mL | ND | ND | ++ | ++ | ++ | +++ | ++ |
| 46 | L44897-116-8 79.5 hrs | >2000 ug/mL | ND | ND | + | + | + | +++ | + |
| 47 | L44897-116-9 123.5 hrs | >2000 ug/mL | ND | ND | ++ | ++ | ++ | +++ | ++ |
| 48 | L44897-139 | >1000 | ND | ++ | ++++ | ++++ | ++++ | ++++ | ++++ |
| 49 | L44166-204 | >1000 | ND | ++++ | ++++ | ++++ | ++++ | ++++ | ++++ |

Chemical Crosslinking Reaction Conditions for the Samples of Triple Mutant Toxin A (SEQ ID NO: 4) Referenced in Table 33

Samples 1-4 were modified with EDC/NHS. Conditions: 30° C., 20 mM MES/150 mM NaCl pH 6.5. Reactions were initiated by addition of EDC. After 2 hours reaction, samples A, B, and C had 1 M glycine added to 50 mM glycine final concentration. Sample D had no glycine added. The reactions were set up with different weight ratios of Mutant toxin A (SEQ ID NO: 4):EDC:NHS as indicated below.

1 L44166-157A 1:0.25:0.25 w:w:w
2 L44166-157B1:1.25:1.25
3 L44166-157C1:2.5:2.5
4 L44166-157D1:2.5:2.5

Sample 5 L44905-160A 80 mM HCHO, 80 mM glycine, 80 mM NaPO$_4$ pH 7, 1 mg/mL Mutant toxin A (SEQ ID NO: 4) Protein, 48 hrs reaction at 25° C.

Sample 6 L44166-166 EDC/NHS modification of Mutant toxin A (SEQ ID NO: 4) at 25° C. in 20 mM MES/150 mM NaCl pH 6.5. Mutant toxin A (SEQ ID NO: 4):EDC:NHS=1:0.5:0.5. Reaction initiated by addition of EDC. After 2 hours reaction, 1M glycine added to 0.1 M glycine final concentration and further 2 hour incubation. After this time, reaction buffer exchanged into 1×PBS on Sephadex G25.

Sample 7 L44905-170A 80 mM HCHO, 80 mM glycine, 80 mM NaPO$_4$ pH 7, 1 mg/mL Mutant toxin A (SEQ ID NO: 4) Protein, 48 hrs reaction at 35 C. This formalin reaction was directed at producing excessive crosslinking so that antigen binding would be severely diminished.

Sample 8 L44897-61 32 mM HCHO/80 mM glycine, 72 hrs reaction at 25° C.

Sample 9 L44897-63 80 mM HCHO/80 mM glycine, 72 hrs reaction at 25° C.

The following reactions all had 24 hrs reaction time.

Sample 10 L44897-72 Tube#1 25° C., 80 mM NaPi pH 6.5, 20 mM HCHO/20 mM glycine
Sample 11 L44897-72 Tube#2 25° C., 80 mM NaPi pH 6.5, 40 mM HCHO/40 mM glycine
Sample 12 L44897-72 Tube#3 32.5° C., 80 mM NaPi pH 7.0, 30 mM HCHO/30 mM glycine
Sample 13 L44897-72 Tube#4 32.5° C., 80 mM NaPi pH 7.0, 30 mM HCHO/30 mM glycine
Sample 14 L44897-72 Tube#5 32.5° C., 80 mM NaPi pH 7.0, 30 mM HCHO/30 mM glycine
Sample 15 L44897-75 Tube#6 25° C., 80 mM NaPi pH 7.5, 20 mM HCHO/20 mM glycine
Sample 16 L44897-75 Tube#7 25° C., 80 mM NaPi pH 7.5, 40 mM HCHO/40 mM glycine
Sample 17 L44897-75 Tube#8 40° C., 80 mM NaPi pH 6.5, 20 mM HCHO/20 mM glycine
Sample 18 L44897-75 Tube#9 40° C., 80 mM NaPi pH 6.5, 40 mM HCHO/40 mM glycine
Sample 19 L44897-75 Tube#10 40° C., 80 mM NaPi pH 7.5, 20 mM HCHO/20 mM glycine
Sample 20 L44897-75 Tube#11 40° C., 80 mM NaPi pH 7.5, 40 mM HCHO/40 mM glycine The following 8 samples were reacted at 25° C. for the indicated times in 80 mM NaPi pH 7.0 containing 78 mM HCHO and 76 mM glycine Sample 21 L44897-101 (pre-modification) TxA control time zero control sample, not modified or exposed to HCHO/glycine
Sample 22 L44897-101, 2 hr
Sample 23 L44897-101, 4 hr
Sample 24 L44897-101, 6 hr
Sample 25 L44897 102, 24 hr
Sample 26 L44897-103, 51 hr
Sample 27 L44897-104, 74 hr
Sample 28 L44897-105, 120 hr Sample 29 (L44980-004) was EDC/NHS modified Mutant toxin A (SEQ ID NO: 4) (triple mutant toxin A (SEQ ID NO: 4)-EDC). Reaction conditions are: 25° C., buffer was 20 mM MES/150 mM NaCl pH 6.6. Triple mutant toxin A (SEQ ID NO: 4):EDC:NHS=1:0.5:0.5 w:w:w. Reaction initiated by addition of EDC. After 2 hours reaction, glycine added to 0.1 M final concentration and reacted further 2 hours at 25 C. Reaction terminated by desalting on Sephadex G25.

The following 12 samples and 2 controls were reversion experiments where samples were incubated at 25° C. and 37° C.

Reaction 1=25° C., 80 mM NaPi pH 7.0, 40 mM HCHO only (no glycine), 24 hour reaction.
Reaction 2=25° C., 80 mM NaPi pH 7.0, 40 mM HCHO/40 mM glycine, 24 hour reaction

| Sample | Reaction |
|---|---|
| 30 | Reaction #1 Week 0, 25° C. |
| 31 | Reaction #1 Week 1, 25° C. |
| 32 | Reaction #1 Week 2, 25° C. |
| 33 | Reaction #1 Week 3, 25° C. |
| 34 | Reaction #1 Week 4, 25° C. |
| 35 | Reaction #1 Week 3, 37° C. |
| 36 | Reaction #2 Week 0, 25° C. |
| 37 | Reaction #2 Week 1, 25° C. |
| 38 | Reaction #2 Week 2, 25° C. |
| 39 | Reaction #2 Week 3, 25° C. |
| 40 | Reaction #2 Week 4, 25° C. |
| 41 | Reaction #2 Week 3, 37° C. |

-continued

| Sample | Reaction |
|---|---|
| 42 | TxA Control Week 3, 25° C. |
| 43 | TxA Control Week 3, 37° C. |

The next 4 samples were generated by reaction for the indicated times at 25° C. in 80 mM NaPi pH 7.0, 40 mM HCHO/40 mM glycine
  44 L44897-116-6 29.5 hrs
  45 L44897-116-7 57.5 hrs
  46 L44897-116-8 79.5 hrs
  47 L44897-116-9 123.5 hrs Sample 48 L44897-139 48 hrs reaction at 25° C., 80 mM NaPi pH 7.0, 40 mM HCHO/40 mM glycine.

Sample 49 L44166-204 EDC/NHS modification of Mutant toxin A (SEQ ID NO: 4). 25 C, buffer 1×PBS pH7.0. Mutant toxin A (SEQ ID NO: 4):EDC:NHS=1:0.5:0.5 w:w:w. 2 hours reaction with EDC/NHS, then 1 M glycine added to 0.1 M final concentration and further 2 hours reaction. Buffer exchanged on Sephadex G25 into 20 mM L-histidine/100 mM NaCl pH 6.5.

TABLE 34

| | Cyto Assay (EC50) | | Reactivity with neut mAb (dot blot, non-denaturing conditions) | | |
|---|---|---|---|---|---|
| | | | mAb # (N-terminal aa 1-543) | mAb # (mid-/C-terminal aa 544-2366) | Strong reactivities |
| Mutant toxin B Sample ID | CPE; 24 h | ATP, 72 h | 8-26 9-30 | 56-6 59-3 | to all 4 mAbs |
| L44905-86-01 Triple mutant toxin B (SEQ ID NO: 6), Untreated Control | <0.1 µg/mL | <0.1 µg/mL | ++++ ++++ | ++++ ++++ | ✓ |
| L44905-86-02 Triple mutant toxin B (SEQ ID NO: 6), Rxn1, 10° C., day 1 | ≧100 µg/mL | 2.2 µg/mL | ++++ ++++ | ++++ ++++ | ✓ |
| L44905-86-03 Triple mutant toxin B (SEQ ID NO: 6), Rxn1, 25° C., day 1 | >100 µg/mL | >100 µg/mL | +++ ++++ | ++ +++ | ✓* |
| L44905-86-04 Triple mutant toxin B (SEQ ID NO: 6), Rxn2, 10° C., day 1 | >100 µg/mL | 5.2 µg/mL | ++++ ++++ | ++++ ++++ | ✓ |
| L44905-86-05 Triple mutant toxin B (SEQ ID NO: 6), Rxn2, 25° C., day 1 | >100 µg/mL | >100 µg/mL | ++++ ++++ | ++ +++ | ✓* |
| L44905-86-06 Triple mutant toxin B (SEQ ID NO: 6), Rxn3, 10° C., day 1 | >100 µg/mL | >100 µg/mL | ++++ − | ++++ +++ | |
| L44905-86-07 Triple mutant toxin B (SEQ ID NO: 6), Rxn3, 25° C., day 1 | >100 µg/mL | >100 µg/mL | ++++ − | ++++ +++ | |
| L44905-86-08 Triple mutant toxin B (SEQ ID NO: 6), Rxn1, 10° C., day 5 | >100 µg/mL | >100 µg/mL | ++++ ++++ | ++++ +++ | ✓ |
| L44905-86-09 Triple mutant toxin B (SEQ ID NO: 6), Rxn1, 25° C., day 5 | >100 µg/mL | >100 µg/mL | ++ ++ | − + | |
| L44905-86-10 Triple mutant toxin B (SEQ ID NO: 6), Rxn2, 10° C., day 5 | >100 µg/mL | >100 µg/mL | ++++ ++++ | ++++ ++++ | ✓ |
| L44905-86-11 Triple mutant toxin B (SEQ ID NO: 6), Rxn2, 25° C., day 5 | >100 µg/mL | >100 µg/mL | ++ ++++ | − + | |
| L44905-86-12 Triple mutant toxin B (SEQ ID NO: 6), Rxn3, 10° C., day 5 | >100 µg/mL | >100 µg/mL | ++++ − | ++++ +++ | |
| L44905-86-13 Triple mutant toxin B (SEQ ID NO: 6), Rxn3, 25° C., day 5 | >100 µg/mL | >100 µg/mL | ++++ − | ++++ ++++ | |
| L44905-86-14 | >100 µg/mL | >100 µg/mL | ++++ ++++ | ++++ ++++ | ✓ |

TABLE 34-continued

| Mutant toxin B Sample ID | Cyto Assay (EC50) CPE; 24 h | ATP, 72 h | mAb # (N-terminal aa 1-543) 8-26 | 9-30 | mAb # (mid-/C-terminal aa 544-2366) 56-6 | 59-3 | Strong reactivities to all 4 mAbs |
|---|---|---|---|---|---|---|---|
| Triple mutant toxin B (SEQ ID NO: 6), Rxn1, 10° C., day 7 L44905-86-15 | >100 µg/mL | >100 µg/mL | +++ | ++++ | − | + | |
| Triple mutant toxin B (SEQ ID NO: 6), Rxn1, 25° C., day 7 L44905-86-16 | >100 µg/mL | >100 µg/mL | +++ | ++++ | +++ | ++++ | ✓ |
| Triple mutant toxin B (SEQ ID NO: 6), Rxn2, 10° C., day 7 L44905-86-17 | >100 µg/mL | >100 µg/mL | ++ | ++ | − | + | |
| Triple mutant toxin B (SEQ ID NO: 6), Rxn2, 25° C., day 7 L44905-86-18 | >100 µg/mL | >100 µg/mL | ++++ | − | ++++ | ++++ | |
| Triple mutant toxin B (SEQ ID NO: 6), Rxn3, 10° C., day 7 L44905-86-19 | >100 µg/mL | >100 µg/mL | +++ | − | ++ | ++ | |
| Triple mutant toxin B (SEQ ID NO: 6), Rxn3, 25° C., day 7 L34346-30A | >100 µg/mL | >100 µg/mL | ++++ | ++++ | ++++ | ++++ | ✓ |
| L34346-30B | >100 µg/mL | >100 µg/mL | +++ | ++++ | ++++ | ++++ | ✓ |
| Commercial, FI Toxoid B (List Biologicals) | ND | ND | ++++ | ++++ | ++++ | ++++ | ✓ |
| Commercial, Control Toxin B wt (List Biologicals) | 22.5 pg/mL | 7.8 pg/mL | +++ | ++ | +++ | +++ | ✓ |
| Control, recombinant triple mutant toxin B (SEQ ID NO: 6) | 78 ng/mL | 72 ng/ml | +++ | ++ | ++++ | +++ | ✓ |

Chemical crosslinking reaction conditions for the samples of mutant toxin B referenced in Table 34

Triple mutant toxin B (SEQ ID NO: 6) was chemically crosslinked and tested according to the following reaction conditions. The L44905-86 samples were tested in an experiment involving three formalin reaction variations and two incubation temperatures. Each day, 6 samples were taken for a total of 18 samples. The first sample in the list is the untreated control (which makes 19 samples total). The untreated control included an untreated triple mutant toxin B polypeptide (SEQ ID NO: 6).

Reaction1 ("Rxn1")=80 mM HCHO, 80 mM glycine, 80 mM NaPO₄ pH 7, 1 mg/mL Triple mutant toxin B (SEQ ID NO: 6) Protein Reaction2 ("Rxn2")=80 mM HCHO, No glycine, 80 mM NaPO₄ pH 7, 1 mg/mL Triple mutant toxin B (SEQ ID NO: 6) Protein Reaction3 ("Rxn3")=80 mM HCHO, No glycine, 80 mM NaPO₄ pH 7, 1 mg/mL Triple mutant toxin B (SEQ ID NO: 6) Protein+Cyanoborohydride capping. Cyanoborohydride Capping involved 80 mM CNBrH₄ added to desalted final reaction and incubated 24 hr at 36° C.

For Sample L34346-30A 0.5 g EDC and NHS per gram of triple mutant toxin B (SEQ ID NO: 6), 4 hours at 30° C., in 20 mM MES, 150 mM NaCl, pH 6.5.

For Sample L34346-30B 0.5 g EDC and NHS per gram of triple mutant toxin B (SEQ ID NO: 6), 2 hours at 30° C. followed by addition of glycine (final concentration of g/L) and incubated another 2 hours at 30° C., in 20 mM MES, 150 mM NaCl, pH 6.5. The only difference between the two reactions for L34346-30A and L34346-30B is the addition of glycine to reaction L34346-30B.

Example 37

Antibodies Induced by Immunogenic Compositions are Capable of Neutralizing Toxins from Various *C. difficile* Strains To assess whether antibodies induced by the immunogenic compositions including the mutant toxin drug substances can neutralize a broad spectrum of diverse toxin sequences, strains representing diverse ribotypes and toxinotypes were sequenced to identify the extent of genetic diversity among the various strains compared to the mutant toxin drug substances. Culture supernatants containing secreted toxins from the various strains were then tested in an in vitro neutralization assay using sera from immunized hamsters to determine the coverage of the immunogenic composition and to determine the ability of the immunogenic composition to protect against diverse toxins from circulating clinical strains.

Both HT-29 cells (colon carcinoma cell line) and IMR-90 cells were used to test the neutralization of toxins expressed from CDC strains. HT-29 cells are more sensitive to TcdA; the $EC_{50}$ of the purified TcdA in these cells is 100 pg/mL as compared to 3.3 ng/mL for TcdB. On the other hand IMR-90 cells are more sensitive to TcdB; the $EC_{50}$ of the purified TcdB in these cells ranges between 9-30 pg/mL as compared to 0.92-1.5 ng/mL for TcdA. The assay specificity for both TcdA and TcdB in these cell lines was confirmed by using both polyclonal and monoclonal toxin-specific antibodies. For assay normalization, culture filtrates of the 24 CDC isolates were tested at a concentration four times their respective $EC_{50}$ value. Three of the strains had toxin levels that were too low for testing in the neutralization assay.

Twenty-four strains representing diverse ribotypes/toxinotypes covering greater than 95% of the circulating strains of *C. difficile* in the USA and Canada were obtained from the CDC. Among these isolates were strains representing ribotypes 027, 001 and 078, three epidemic strains of CDAD in the United States, Canada and UK. Strains 2004013 and 2004118 represented ribotype 027; strain 2004111 represented ribotype 001 and strains 2005088, 2005325 and 2007816 represented ribotype 078. To identify the extent of genetic diversity between the disease-causing clinical isolates and the 630 strain, the toxin genes (tcdA and tcdB) from these clinical strains were fully sequenced. See Table 35. The amino acid sequences of the toxins were aligned using ClustalW in the Megalign™ program (DNASTAR® Lasergene®) and analyzed for sequence identity. For tcdA, genomic alignment analysis showed that all of the clinical isolates and strain 630 shared overall about 98-100% amino acid sequence identity. The C-terminal portion of the tcdA gene was slightly more divergent. The same analysis was performed for the tcdB gene which exhibited greater sequence divergence. Notably strains 2007838/NAP7/126 and 2007858/NAP1/unk5 displayed the most divergent patterns from the 630 strain in the N terminal (79-100%) and the C terminal domains (88-100%; data not shown).

A hamster serum pool (HS) was collected from the Syrian golden hamsters that were immunized with an immunogen including mutant TcdA (SEQ ID NO: 4) and mutant TcdB (SEQ ID NO: 6), wherein the mutant toxins were inactivated with EDC, according to, for example, Example 29, Table 15, described above, and formulated with aluminum phosphate. The results in Table 35 show that at least toxin B from the respective culture supernatants were neutralized, in an in vitro neutralization assay, by sera from the immunized hamsters.

TABLE 35

Description of *C. difficile* strains from CDC and Ability of Immune Hamster Sera to Neutralize Various Toxins

| Strain | PFGE Type | Ribotype | Neutralized by Hamster Sera |
|---|---|---|---|
| 2005088 | NAP7 | 78 | yes |
| 2007816 | NAP7-related | 78 | yes |
| 2005325 | NAP7 | 78 | yes |
| 2004013 | NAP1 | 27 | yes |
| 2007886 | NAP1 | | yes |
| 2008222 | NAP4 | 77 | yes |
| 2004206 | NAP4 | 154 | yes |
| 2005283 | NAP5 | Unk3 | Not tested[b] |
| 2009141 | NAP2 | | yes |
| 2007838 | NAP7 | 126 | yes |
| 2004111 | NAP2 | 1 | yes |
| 2007070 | NAP10 | 70 | yes |
| 2006017 | NAP12 | 15 | yes |
| 2009078 | NAP11 | 106 | Not tested[b] |
| 2007217 | NAP8 | 126 | yes |
| 2006376 | NAP9 | 17 | yes |
| 2007302 | NAP11 | Unk2 | yes |
| 2004118 | NAP1 | 27 | yes |
| 2005022 | NAP3 | 53 | yes |
| 2009292 | NAP1 | | yes |
| 2004205 | NAP6 | 2 | yes |
| 2007858 | NAP1 | Unk5 | yes |
| 2009087 | NAP11 | 106 | Not tested[b] |
| 2005359 | NAP1-related | | yes |

[b]Toxin levels were too low to perform the neutralization assay.

Figure 23A:
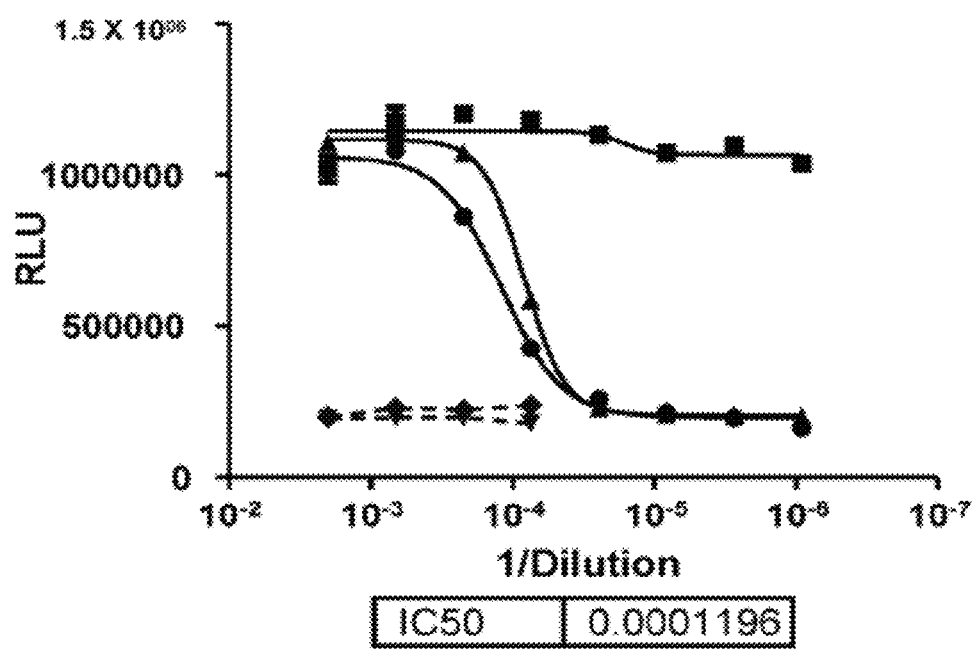
Figure 23B:
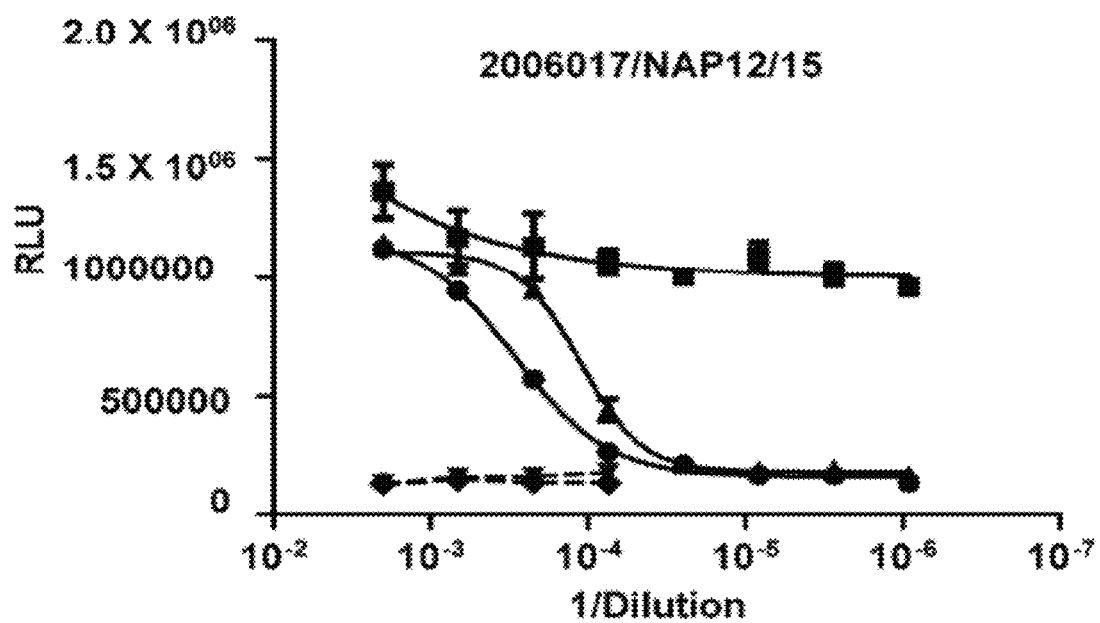
Figure 23C:
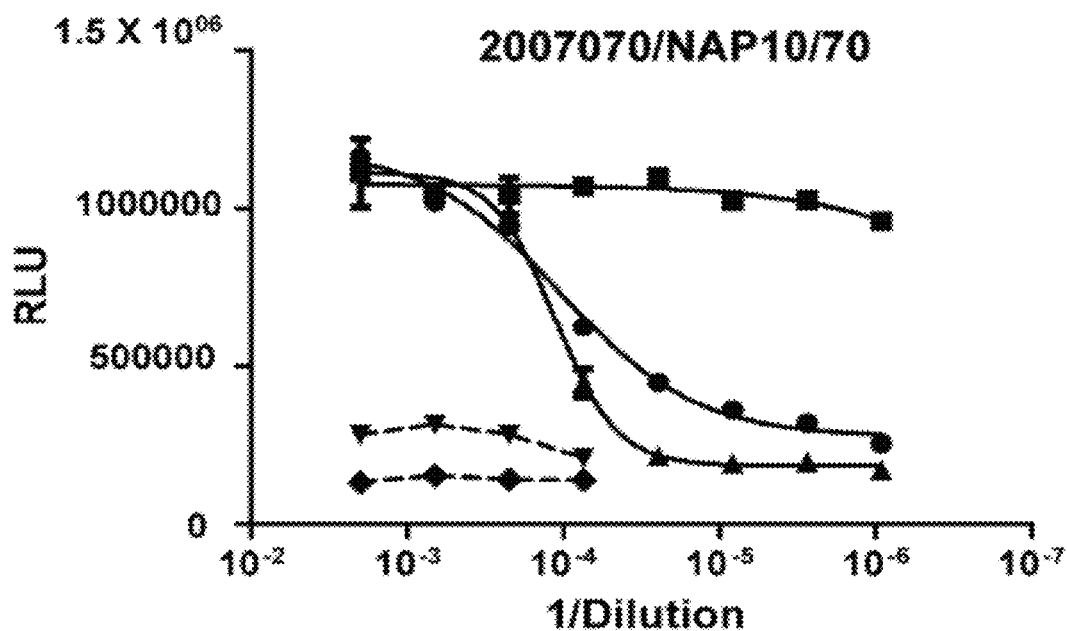
Figure 23D:
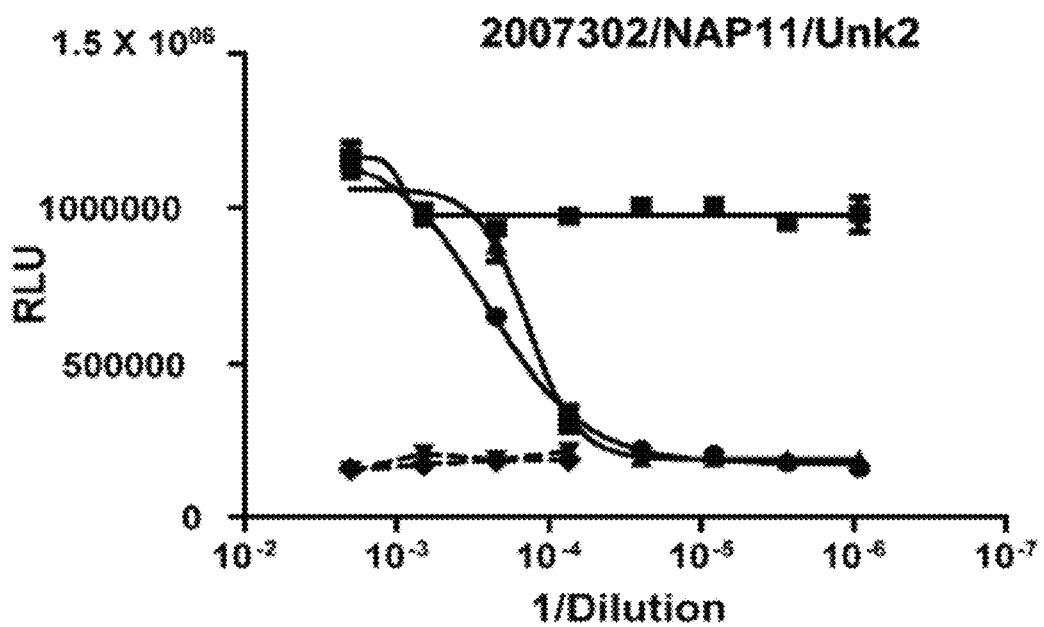
Figure 23E:
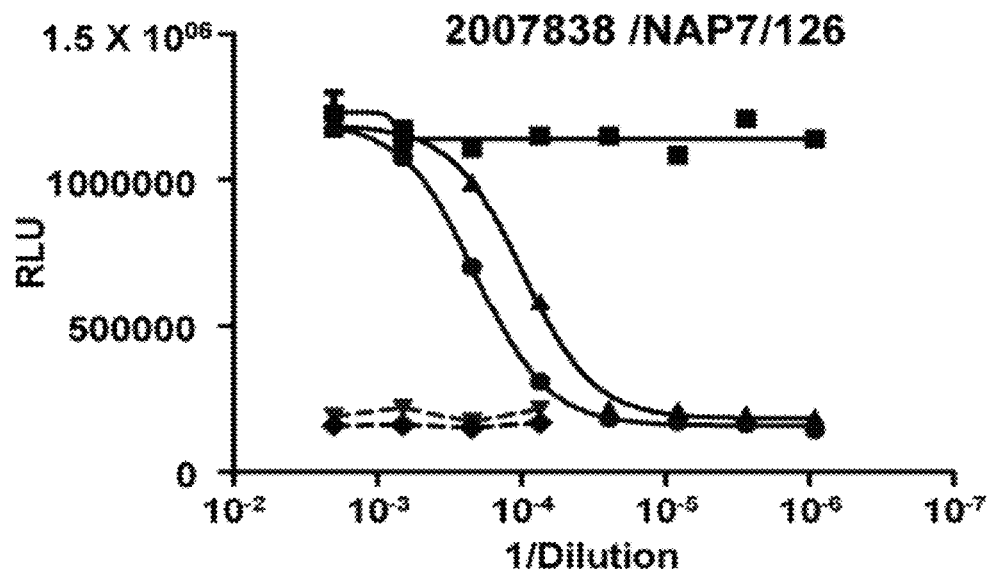
Figure 23F:
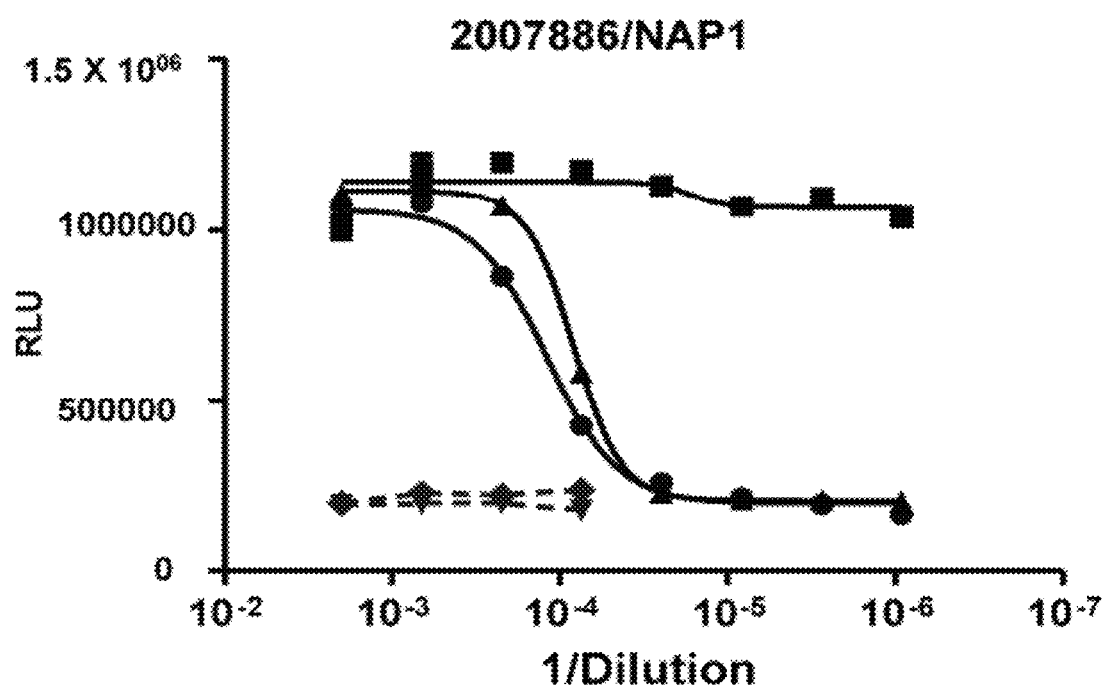
Figure 23G:
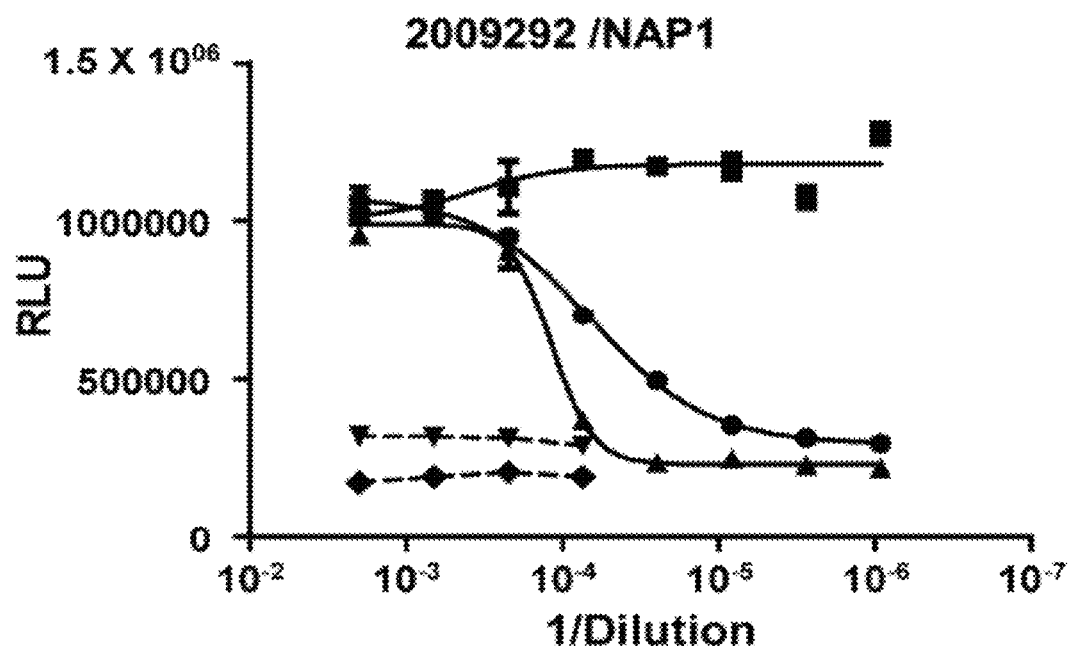
Figure 23H:
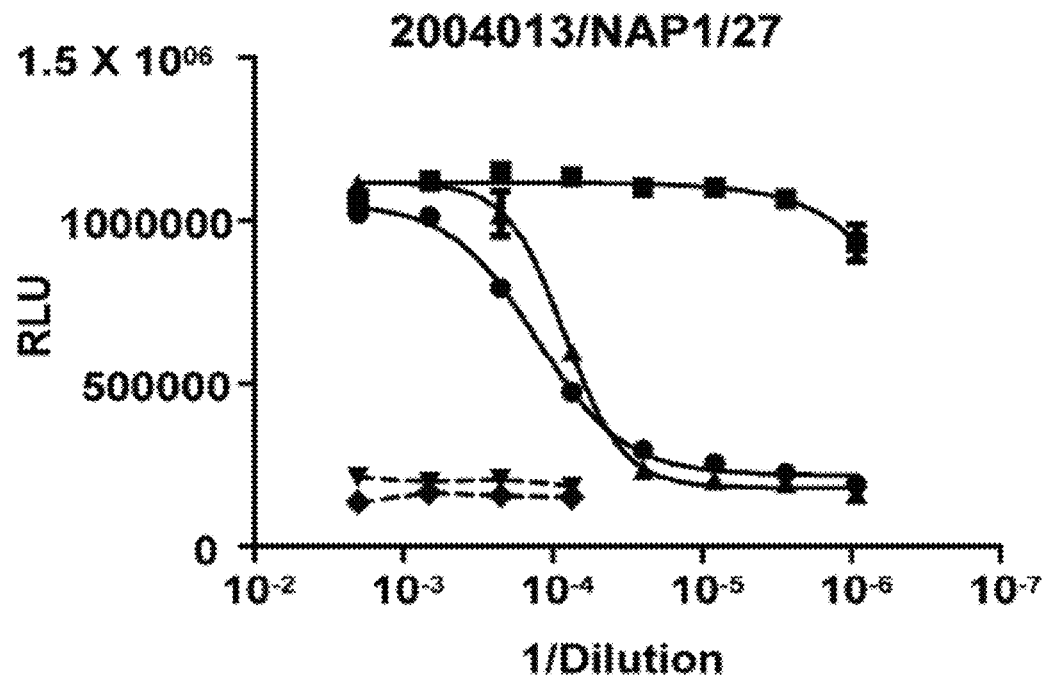
Figure 23:
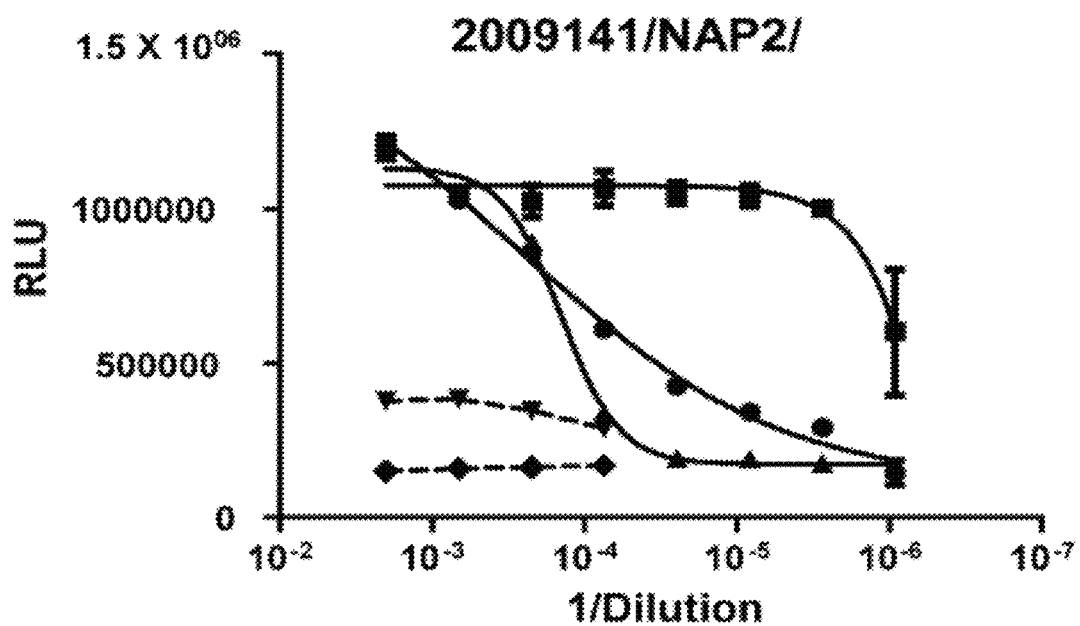
FIG. 23 shows that an immunogenic composition including mutant TcdA (SEQ ID NO: 4) and mutant TcdB (SEQ ID NO: 6), wherein the mutant toxins were inactivated with EDC, according to, for example, Example 29, Table 15, described herein, induced neutralizing antibodies that exhibited neutralizing activity against toxins from at least the following 16 different CDC strains of C. difficile, in comparison to the respective toxin only control: 2007886 (FIG. 23A); 2006017 (FIG. 23B); 2007070 (FIG. 23C); 2007302 (FIG. 23D); 2007838 (FIG. 23E); 2007886 (FIG. 23F); 2009292 (FIG. 23G); 2004013 (FIG. 23H); 2009141 (FIG. 23I); 2005022 (FIG. 23J); 2006376 (FIG. 23K).
Figure 23J:
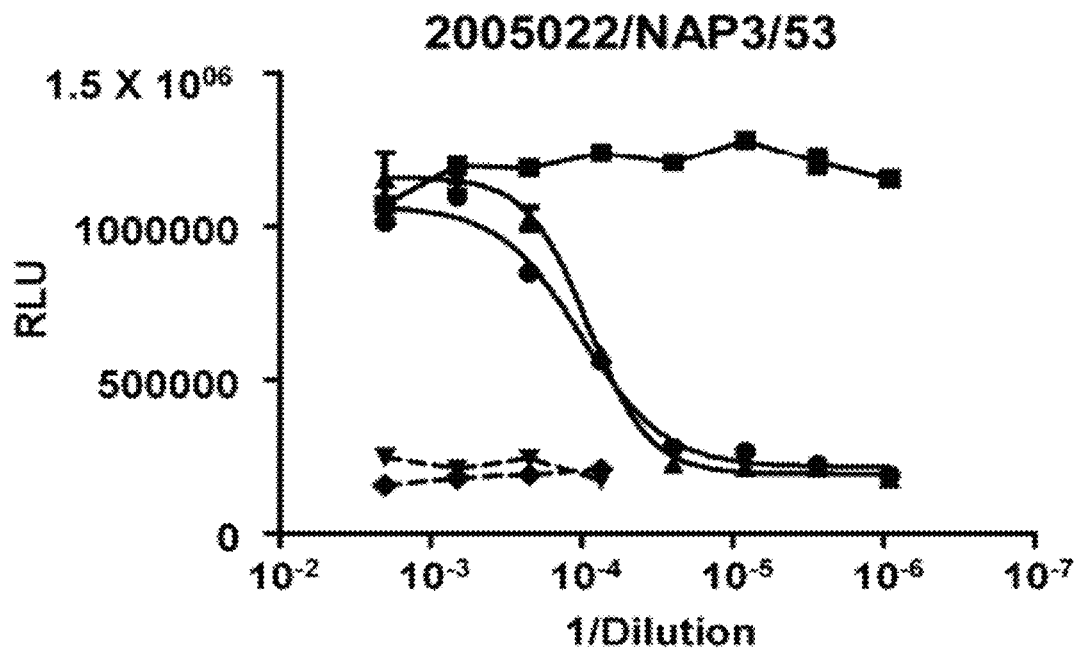

FIG. 23 depicts the results of the neutralization assay using toxin preparations from various *C. difficile* strains on IMR-90 cells. The data show TcdB neutralizing antibodies in the hamster antisera were capable of neutralizing toxins from all 21 isolates tested, including hypervirulent strains and a TcdA-negative, TcdB-positive strain. At least 16 different strains of *C. difficile* were obtained from the CDC (Atlanta, Ga.)(previously described) and were cultured in *C. difficile* culture media under suitable conditions as known in the art and as described above. Culture supernatants containing the secreted toxins were analyzed to determine their cytotoxicity ($EC_{50}$) on IMR-90 monolayers and subsequently tested in a standard in vitro neutralization assay at 4 times the $EC_{50}$ using various dilutions of sera from hamsters immunized with mutant toxin A drug substance and mutant toxin B drug substance, formulated with aluminium phosphate. Crude toxin obtained from culture supernatants of each strain and purified toxin (commercial toxin obtained from List Biologicals)(not purified from respective supernatants) were tested for cytotoxicity to IMR-90 cells using the in vitro cytotoxicity assay described above.

In FIGS. 23A-K, the graphs show results from in vitro cytotoxicity tests (previously described) in which the ATP levels (RLUs) are plotted against increasing concentrations of: *C. difficile* culture media and the hamster serum pool (■); crude toxin and the hamster serum pool (●); purified toxin and the hamster serum pool (▲); crude toxin (▼), control; and purified toxin (♦), control. The toxins from the respective strains were added to the cells at $4 \times EC_{50}$ values.

As shown in FIGS. 23A-K, the hamsters that received the described immunogen surprisingly developed neutralizing antibodies that exhibited neutralizing activity against toxins from at least the following 16 different CDC strains of *C. difficile*, in comparison to the respective toxin only control: 2007886 (FIG. 23A); 2006017 (FIG. 23B); 2007070 (FIG. 23C); 2007302 (FIG. 23D); 2007838 (FIG. 23E); 2007886 (FIG. 23F); 2009292 (FIG. 23G); 2004013 (FIG. 23H);

2009141 (FIG. 23I); 2005022 (FIG. 23J); 2006376 (FIG. 23K). See also Table 35 for additional *C. difficile* strains from which toxins were tested and were neutralized by the immunogenic composition including a mutant toxin A drug substance and mutant toxin B drug substance, formulated in aluminum phosphate.

In another study, culture supernatants containing secreted toxins from the various *C. difficile* strains (obtained from the CDC and from Leeds Hospital, UK) were tested in the in vitro neutralization assay using sera from hamsters that were administered with mutant toxin A drug substance and mutant toxin B drug substance, formulated with Alhydrogel. See Table 36 for the experimental design. The results are shown in Table 37 and Table 38.

TABLE 36

Experimental design

| | |
|---|---|
| Assay Control | In assay using HT-29 cells: Rabbit anti-serum (Anti-Toxin A polyclonal Fitzgerald Industries, #70-CR65) and Reference Toxin A (wild-type toxin A from List Biologicals) In assay using IMR-90 cells: Rabbit anti-serum (Anti-Toxin B polyclonal Meridian Life Science, #B01246R) and Reference Toxin B (wild-type toxin B from List Biologicals) |
| Sample Controls | In assay using HT-29 cells: HS serum + Reference Toxin A In assay using IMR-90 cells: HS serum + Reference Toxin B HS serum + 630 wt toxin HS serum + Culture media of IMR-90 or HT-29 cell line HS serum + culture supernatant of VPI11186 |
| Test Sample | HS + respective *C. difficile* culture supernatant |
| Source of Hamster antiserum (HS) | Animals administered with mutant toxin A drug substance and mutant toxin B drug substance formulated with Alhydrogel |

TABLE 37

Immunogenic Composition-induced Antibodies Neutralized Toxin A and Toxin B from Various Wild-type *C. difficile* Strains from the CDC, including Hypervirulent strains

| Cdiff Strain | PFGE Type | Ribotype | Toxinotype | Other Typing Method | Neutralized by HS (IMR-90, Toxin B) | Neutralized by HS (HT-29, Toxin A) |
|---|---|---|---|---|---|---|
| 2004111 | NAP2 | 1 | 0 | Respective toxin sequence has 100% Homology to toxin from Strain 630 | Yes | Yes |
| 2009141 | NAP2 | | 0 | | Yes | Yes |
| 2006017 | NAP12 | 15 | 0 | | Yes | Yes |
| 2007302 | NAP11 | Unk2 | 0 | | Yes | Yes |
| 2009087 | NAP11 | 106 | 0 | | Yes | Yes |
| 2005022 | NAP3 | 53 | 0 | | Yes | Yes |
| 2005283 | NAP5 | Unk3 | 0 | | Yes | Yes |
| 2009078 | NAP5 | 53 | 0 | | Yes | Yes |
| 2004206 | NAP4 | 154 | 0 | | Yes | Yes |
| 2008222 | NAP4 | 77 | 0 | | Yes | Yes |
| 2004205 | NAP6 | 2 | 0 | | Yes | Yes |
| 2007070 | NAP10 | 70 | 0 | | Yes | Yes |
| 2006376 | NAP9 | 17 | VIII | txnA−/txnB+ | Yes | N/A |
| 2007816 | NAP7-related | 78 | V | Increasing prevalence in US and Europe | Yes | Yes |
| 2007838 | NAP7 | 126 | | | Yes | Yes |
| 2005088 | NAP7 | 78 | | | Yes | Yes |
| 2005325 | NAP7 | 78 | | | Yes | Yes |
| 2007217 | NAP8 | 126 | | | Yes | Yes |
| 2004013 | NAP1 | 27 | III | Hypervirulent NAP1/027/III | Yes | Yes |
| 2004118 | NAP1 | 27 | | | Yes | Yes |
| 2009292 | NAP1 | | | | Yes | Yes |
| 2005359 | NAP1-related | | | | Yes | Yes |
| 2007858 | NAP1 | Unk5 | IX/XXIII | Other | Yes | Yes |
| 2007886 | NAP1 | | IX/XXIII | | Yes | Yes |

TABLE 38

Immunogenic Composition-induced Antibodies Neutralized Toxin A and Toxin B from Various Wild-type *C. difficile* Strains from Europe, including Hypervirulent strains

| Cdiff Strain | PFGE Type | Other Typing Method | Toxin type | Neutralized by HS (IMR-90, Toxin B) | Neutralized by HS (HT-29, Toxin A) |
|---|---|---|---|---|---|
| 001 | NAP2 | Toxinotype 0 Strains | 0 | Yes | Yes |
| 002 | NAP6 | | | Yes | Yes |
| 012 (004) | NAPCR1 | | | Yes | Yes |
| 014 | UK | | | Yes | Yes |
| 015 | NAP12 | | | Yes | Yes |
| 020 | NAP4 | | | Yes | Yes |
| 029 | UK | | | Yes | Yes |
| 046 | UK | | | Yes | Yes |
| 053 | NAP5 | | | Yes | Yes |
| 059 | UK | | | Yes | Yes |
| 077 | UK | | | Yes | Yes |
| 078 | UK | | | Yes | Yes |
| 081 | UK | | | Yes | Yes |
| 087 | UK | | | Yes | Yes |
| 095 | UK | | | Yes | Yes |
| 106 | UK | | | Yes | Yes |
| 117 | UK | | | Yes | Yes |
| 017 | NAP9 | txnA−/txnB+ | VIII | Yes | NA |
| 027 | NAP1 | Hypervirulent | III | Yes | Yes |
| 075 | UK | | | Yes | Yes |
| 003 | NAP10 | | I | Yes | Yes |
| 023 | UK | | IV | Yes | Yes |

TABLE 38-continued

Immunogenic Composition-induced Antibodies Neutralized
Toxin A and Toxin B from Various Wild-type C. difficile
Strains from Europe, including Hypervirulent strains

| Cdiff Strain | PFGE Type | Other Typing Method | Toxin type | Neutralized by HS (IMR-90, Toxin B) | Neutralized by HS (HT-29, Toxin A) |
|---|---|---|---|---|---|
| 070 | UK | Other | XIII | Yes | Yes |
| 126 | UK | | UK | Yes | Yes |
| 131 | UK | | UK | In Progress | Yes |

Wild-type C. difficile strains obtained from Leeds Hospital, UK.
"UK" = unknown status
NA, not applicable; strain does not make toxin A; was not tested in Toxin A neutralization assay Example 38

Peptide Mapping of EDC/NHS Triple Mutant Toxins

To characterize the EDC/NHS inactivated triple mutant toxins, peptide mapping experiments were performed on four lots of EDC/NHS-treated triple mutant toxin A (SEQ ID NO: 4) and four lots of EDC/NHS-treated triple mutant B (SEQ ID NO: 6). After digesting the mutant toxins with trypsin, the resulting peptide fragments were separated using reverse-phase HPLC. Mass spectral analysis was used to identify modifications that occur as a result of the inactivation process. For both mutant toxin A drug substance and mutant toxin B drug substance, greater than 95% of the theoretical tryptic peptides were identified. Crosslinks and glycine adducts (glycine was used as the capping agent) were identified. In both mutant toxin A drug substance and mutant toxin B drug substance, beta-alanine adducts were also observed. Without being bound by mechanism or theory, the beta-alanine adducts appear to result from the reaction of three moles of NHS with one mole of EDC which forms NHS activated beta-alanine. This molecule can then react with lysine groups to form beta-alanine adducts (+70 Da). In the EDC/NHS-treated triple mutant toxin B samples, low levels (0.07 moles/mole protein) of dehydroalanine (−34 Da) were also observed. Dehydroalanine is a result of de-sulfonation of a cysteine residue. The same type and degree of modification was observed in all four batches of each mutant toxin, indicating that the process produces a consistent product. Peptide mapping (at greater than 95% sequence coverage) confirms that modifications are present. A summary of the modifications are shown in Table 39. See also FIGS. 24-25. In addition, the size and charge heterogeneity of the triple mutant toxin A drug substance and of the triple mutant toxin B drug substance increased, as compared to the size and charge heterogeneity of the respective triple mutant toxin A and triple mutant toxin B in the absence of chemical inactivation. As a result, the size-exclusion chromatography (SEC) and anion-exchange chromatography (AEX) profiles had relatively broad peaks (data not shown).

TABLE 39

Summary of Modifications Observed
in Mutant Toxin Drug Substances

| Modification | # of Modified Residues | Total # of Residues | Degree of Modification | Moles modified/ mole protein |
|---|---|---|---|---|
| Mutant toxin A drug substance | | | | |
| Crosslink | 2 | 313 Asp/Glu | 16-40% | 0.6 |
| Glycine moiety | 8 | 313 Asp/Glu | 10-53% | 2.2 |
| Beta Alanine moiety | 19 | 233 Lys | 10-60% | 4.7 |
| Mutant toxin B drug substance | | | | |
| Crosslink | 3 | 390 Asp/Glu | 11-63% | 0.8 |
| Glycine moiety | 23 | 390 Asp/Glu | 10-31% | 3.9 |
| Beta Alanine moiety | 10 | 156 Lys | 12-42% | 2.6 |
| dehydroalanine | 2 | 8 Cys | 1.0-3.5% | .07 |

The degree of modification is calculated by dividing the HPLC area of modified peptide by the HPLC area of the native + modified peptide.

Example 39

Drug Product Production

The C. difficile immunogenic composition (drug product) contains two active pharmaceutical ingredients (mutant toxin A drug substance and mutant toxin B drug substance). An exemplary drug product is a lyophilized formulation containing 10 mM Tris buffer pH 7.4, 4.5% (w/w) trehalose dihydrate, and 0.01% (w/v) polysorbate 80, including each of a mutant toxin A drug substance and a mutant toxin B drug substance. See Table 40. The immunogenic composition is prepared for injection by resuspending the lyophilized vaccine either with diluent or with diluent containing Alhydrogel. The placebo will include a sterile normal saline solution for injection (0.9% sodium chloride).

TABLE 40

| Component | Selected |
|---|---|
| Formulation dosage form | Lyophilized |
| Antigen dose per 0.5 mL | 25, 50, 100 μg of each EDC/NHS-treated triple mutant toxin A (SEQ ID NO: 4) and EDC/NHS-treated triple mutant toxin B (SEQ ID NO: 6) |
| pH | 7.4 ± 0.5 |
| Buffer | 10 mM Tris |
| Stabilizer/Bulking agent | 4.5% Trehalose dihydrate (3-6%) |
| Surfactant | 0.01% Polysorbate 80 (0.005-0.015%) |
| Container closures | 2 mL 13 mm Type 1 flint glass Vial, Blowback, West - Flurotec |

Buffer Preparation

Water for injection (WFI) is added to a compounding vessel. While mixing, the excipients are added and dissolved until into solution. The pH is measured. If required, the pH is adjusted to 7.4±0.1 with HCl. The solution is diluted to the final weight with WFI then filtered using a 0.22 μm Millipore Express SHC XL150 filter. A pre-filtration bioburden reduction sample is taken prior to filtration. The filtered buffer is sampled for osmolality and pH.

Formulation Preparation

The thawed mutant toxin Drug Substances are pooled in the formulation vessel based on the precalculated amounts in the following order of operation: 50% of the target dilution buffer volume to achieve 0.6 mg/mL is added to the vessel first, followed by addition of mutant toxin A drug substance and mixed for 5 minutes at 100 rpm. Mutant toxin B drug substance is then added to the vessel and the solution is further diluted to 0.6 mg/mL dilution point and then mixed for another 5 minutes at 100 rpm. A sample is removed and tested for total mutant toxin concentration. The solution is diluted to 100 percent volume based on the in-process mutant toxin concentration value then mixed for 15 minutes at 100 rpm. The formulated drug product is sampled for pH and bioburden pre-filtration. The formulated drug product is then filtered using a Millipore Express SHC XL150 for overnight storage, or brought to the filling line for sterile filtration.

The formulated bulk is brought to the filling area, sampled for bioburden, and then sterile filtered with two in-series Millipore Express SHC XL150 filters. The formulated bulk is filled into depyrogenated glass vials at a target fill volume of 0.73 mL. The filled vials are partially stoppered and then loaded into the freeze dryer. The lyophilization cycle is executed as shown in Table 41. At the completion of cycle, the lyophilization chamber is back-filled with nitrogen to 0.8 atm and then the stoppers are fully seated. The chamber is unloaded and the vials are capped using flip-off seals.

TABLE 41

*C. difficile* Drug Product Lyophilization Cycle Set Points

| Step | Temperature (° C.) | Ramp (minutes) | Soak (minutes) | Pressure |
|---|---|---|---|---|
| Loading | 5° C. | N/A | 60 | — |
| Freezing 1 | −50° C. | 183 | 60 | — |
| Annealing | −10° C. | 133 | 180 | |
| Freezing 2 | −45° C. | 117 | 90 | |
| Vacuum Initiation | −45° C. | — | 60 | 50 |
| Primary Drying | −30° C. | 75 | 3420 | 50 |
| Secondary Drying | 30° C. | 300 | 600 | 50 |
| Storage | 5° C. | 50 | — | 50 |

Drug product stability data is summarized in Table 42. The data suggest that the drug product is physically and chemically stable during storage at 2-8° C. for at least 3 months or at least 1 month at 25° or 40° C. Under both storage conditions, the level of impurities detected by size exclusion chromatography (SEC) did not change, nor were there changes in in vitro antigenicity through the latest timepoints tested.

TABLE 42

Stability of Lyophilized Drug Product [a]

| | Drug Product Formulation 200 μg/mL mutant toxin A drug substance, 200 μg/mL mutant toxin B drug substance, 4.5% Trehalose dihydrate, 0.01% Polysorbate 80, 10 mM Tris buffer pH 7.4 | | | |
|---|---|---|---|---|
| Test | t = 0 | 1 Month@25° C. | 1 Month@40° C. | 3 months @2-8° C. |
| Appearance before Reconstitution. | White cake essentially free from visible foreign particulate matter | White cake essentially free from visible foreign particulate matter | White cake essentially free from visible foreign particulate matter | White cake essentially free from visible foreign particulate matter |
| Appearance after Reconstitution. | Clear colorless solution | Clear colorless solution | Clear colorless solution | Clear colorless solution |
| pH | 7.5 | 7.6 | 7.6 | 7.5 |
| Strength by AEX (μg/mL) | mutant toxin A drug substance 212 mutant toxin B drug substance 235 | Mutant toxin A drug substance 193 mutant toxin B drug substance 223 | Mutant toxin A drug substance 191 Mutant toxin B drug substance 222 | Mutant toxin A drug substance 193 mutant toxin B drug substance 230 |
| Impurity by SEC | <2.5% | 2.8% | 2.8% | 2.9% |
| Characterization by SEC | HMMS: 29.6% Monomer: 68.0% | HMMS: 30.2% Monomer: 67.1% | HMMS: 30.2% Monomer: 67.1% | HMMS: 28.5% Monomer: 68.7% |
| Moisture | 0.5 | NA | NA | NA |

[a] Lyophilized DP is reconstituted with 60 mM NaCl diluent for these tests.

Example 40

Vaccine diluents

For saline, 60 mM NaCl is used as a diluent for the lyophilized drug product without any adjuvant to ensure an isotonic solution upon reconstitution.

Alhydrogel: Alhydrogel "85" 2% (Brenntag) is a commercially available Good Manufacturing Practice (GMP) grade product composed of octahedral crystalline sheets of aluminum hydroxide. An exemplary Alhydrogel diluent formulation is shown in Table 43. The exemplary formulation may be used in combination with the drug product described above.

TABLE 43

Formulation Rationale for Alhydrogel Diluent

| Component | Selected |
|---|---|
| Formulation dosage form | Liquid Suspension |
| Adjuvant dose per 0.5 mL | 0.5 mg Al |
| pH | 6.5 ± 0.5 |
| Buffer | 10 mM His |
| Salt | 60 mM NaCl |
| Container closures | 2 mL 13 mm Type 1 Flint Glass Vial, Blowback, West - Flurotec |

Studies with the Alhydrogel adjuvant show 100% binding of mutant toxin A drug substance and mutant toxin B drug substance to 1 mg Al/mL Alhydrogel from pH 6.0 to 7.5. Maximum binding of both drug substances was seen at the highest protein concentration tested (300 μg/mL each).

The binding of the proteins to Alhydrogel was also tested with the lyophilized drug product formulation containing 200 μg/mL of each drug substance and Alhydrogel ranging from 0.25 to 1.5 mg/ml. The drug product was reconstituted with diluents containing the varying concentrations of Alhydrogel and the percent of each mutant toxin bound was measured. All tested concentrations of Alhydrogel demonstrated 100% binding of the antigens.

The binding kinetics of the proteins to Alhydrogel at the target dose of mutant toxin A drug substance and mutant toxin B drug substance (200 μg/mL each) were also assessed. The results show that 100% of the mutant toxin drug substances were bound to Alhydrogel throughout the 24-hour RT time course.

CpG 24555 and Alhydrogel: CpG 24555 is a synthetic 21-mer oligodeoxynucleotide (ODN) having a sequence 5-TCG TCG TTTTTC GGT GCT TTT-3 (SEQ ID NO: 48). An exemplary formulation for a combination of CpG 24555 and Alhydrogel diluents is shown in Table 44. The exemplary formulation may be used in combination with the drug product described above.

TABLE 44

Formulation Rationale for CpG/Alhydrogel Diluent

| Component | Selected |
|---|---|
| Formulation dosage form | Liquid Suspension |
| Adjuvant dose per 0.5 mL | 0.5 mg Al and 1 mg cpG |
| pH | 6.5 ± 0.5 |
| Buffer | 10 mM His |
| Salt | 60 mM NaCl |
| Container closures | 2 mL 13 mm Type 1 Flint Glass Vial, Blowback, West - Flurotec |

ISCOMATRIX®: The ISCOMATRIX® adjuvant is a saponin-based adjuvant known in the art. An exemplary formulation for the ISCOMATRIX® adjuvant formulation is shown in Table 45. The exemplary formulation may be used in combination with the drug product described above.

TABLE 45

Formulation Rationale for ISCOMATRIX ® Diluent

| Component | Selected |
|---|---|
| Formulation dosage form | Liquid Suspension |
| Adjuvant dose per 0.5 mL | 45 units |
| pH | 6.2 ± 0.5 |
| Buffer | 10 mM phosphate |
| Salt | 60 mM NaCl |
| Container closures | 2 mL 13 mm Type 1 Flint Glass Vial, Blowback, West - Flurotec |

Example 41

Immunogenicity of Mutant Toxin Drug Substance Compositions Adjuvanted with Alhydrogel in NHP Model and Preclinical Proof of Concept The immunogenicity of mutant toxin A drug substance and mutant toxin B drug substance compositions adjuvanted with Alhydrogel in NHPs was assessed, specifically cynomolgus macaques. NHPs immunized at two-week intervals (weeks 0, 2, 4) with 10 μg of each mutant toxin A drug substance and mutant toxin B drug substance compositions (formulated with Alhydrogel) per dose, developed robust neutralizing antitoxin responses. See Table 46. Both antitoxin A and antitoxin B neutralizing responses reached a protective range after the third immunization and remained within or above the protective range at least through week 33 (last timepoint studied).

Cynomolgus macaques (n=8) were immunized IM at 0, 2 and 4 weeks with 10 μg each of mutant toxin A drug substance and mutant toxin B drug substance formulated in 250 μg of Alhydrogel. Sera was collected at each time point and analyzed in the toxin neutralization assay for functional antitoxin activity. GMTs are provided in Table 46. The protective titer range provided in the table depicts the neutralizing antibody titer range which correlates to significant reduction in recurrence of *C. difficile* infection in the Merck monoclonal antibody therapy trial.

TABLE 46

Immunogenicity of Mutant Toxin A Drug Substance and Mutant Toxin B Drug Substance (Formulated in 250 μg Alhydrogel) in Cynomolgus Monkeys (50% Neutralization Titer)

| | Week: | | | | | | | | | | | |
|---|---|---|---|---|---|---|---|---|---|---|---|---|
| | Wk 0 | Wk 1 | Wk 2 | Wk 3 | Wk 4 | Wk 5 | Wk 6 | Wk 8 | Wk 12 | Wk 25 | Wk 29 | Wk 33 |
| Antitoxin A (Merck/Medarex protective range: 666-6,667 for antitoxin A) | | | | | | | | | | | | |
| Titer: | 15 | 19 | 129 | 382 | 336 | 2469 | 3069 | 2171 | 1599 | 1520 | 1545 | 2178 |
| Antitoxin B (Merck/Medarex protective range: 222-2,222 for antitoxin B) | | | | | | | | | | | | |
| Titer: | 10 | 10 | 10 | 10 | 20 | 311 | 410 | 446 | 676 | 1631 | 2970 | 3510 |

Correlation of Human Protective Antibody Titers from Merck mAb Therapy Trial to Titers Induced by Pfizer's Vaccine Candidate in NHPs The Phase 2 efficacy study with Merck/Medarex mAbs (Lowy et al., N Engl J. Med. 2010 Jan. 21; 362(3):197-205) seemed to demonstrate a correlation between the level of neutralizing antitoxin mAbs in the serum and the prevention of recurrence of CDAD. After administration of the toxin-specific mAbs to humans, serum antibody levels in human recipients in the range of 10 to 100 μg/mL appear to protect against recurrences (70% reduction in the recurrence of CDAD).

Immunogenic compositions including the mutant toxin drug substances were tested to gauge whether the immunogenic compositions are capable of inducing a potentially efficacious neutralizing antibody responses in humans by comparing published data from the Merck/Medarex Phase 2 study to the levels of antibody induced by the immunogenic compositions in the NHP model. This was accomplished by utilizing previously published characteristics of the Merck/Medarex mAbs to convert the range of these mAbs in the serum obtained from subjects that displayed no sign of recurrences (10-100 μg/mL) into 50% neutralization titers and comparing these titers ("protective titer range") to the titers observed in the preclinical models described herein. As shown in Table 46, the immunogenic compositions including the mutant toxin A drug substance and mutant toxin B drug substance adjuvanted with Alhydrogel generated immune responses in NHPs that reached the "protective range" after the third dose and have remained within or above this range through week 33. The level of toxin-neutralizing antibodies induced in NHPs by the inventive C. difficile immunogenic composition is comparable to the serum antibody levels in the Merck/Medarex trial subjects who appeared to be protected from recurrences of CDAD.

Example 42

Immunogenicity of Mutant Toxin Drug Substance Compositions Adjuvanted with ISCOMATRIX or Alhydrogel/CpG 24555 (Alh/CpG) in NHP Model In NHPs, both ISCOMATRIX and Alh/CpG statistically significantly enhanced antitoxin A and B neutralization titers when compared to vaccine administered with Alhydrogel alone (Table 47). Antitoxin responses above background were elicited at earlier time points by vaccine administered with either Alh/CpG or ISCOMATRIX (week 2-4) as compared to Alhydrogel alone (week 4-6), which may have an important effect on protection from recurrence of CDAD in humans. Compared to Alhydrogel, the immunogenic composition adjuvanted with Alh/CpG or with ISCOMATRIX generated antitoxin neutralization titers that reached the protective range (see also Example 41) more swiftly and that have remained within or above this range through week 33.

As shown in Table 47, Cynomolgus macaques were immunized IM at weeks 0, 2, and 4 with 10 μg each of mutant toxin A drug substance and mutant toxin B drug substance formulated in 250 μg of Alhydrogel (n=8), or 500 μg of CpG+250 μg of Alhydrogel (n=10), or 45 U of ISCOMATRIX (n=10). Sera were collected at each time point and analyzed in the toxin neutralization assay described above for functional antitoxin activity. GMTs are listed in the tables. Asterisks (*) indicate statistical significance (p<0.05) when compared to titers in the Alhydrogel group. The protective titer range represents the neutralizing antibody titer range which correlates to significant reduction in recurrence of C. difficile infection according to the Merck/Medarex mAb therapy trial.

TABLE 47

Immunogenicity of Adjuvanted Mutant Toxin Drug Substances in NHPs (50% Neutralization Titer)

| | Week: | | | | | | |
|---|---|---|---|---|---|---|---|
| | Wk 0 | Wk 2 | Wk 4 | Wk 6 | Wk 12 | Wk 25 | Wk 33 |
| Antitoxin A (Merck/Medarex protective range: 666-6,667 for antitoxin A) | | | | | | | |
| Alhydrogel Titer: | 15 | 129 | 336 | 3069 | 1599 | 1520 | 2178 |
| Alhydrogel + CpG Titer: | 17 | *1004 | *2162 | *15989 | *7179 | *5049 | *7023 |
| ISCOMATRIX Titer: | 25 | *1283 | *3835 | *19511 | *12904 | *6992 | *7971 |
| Antitoxin B (Merck/Medarex protective range: 222-2,222 for antitoxin B) | | | | | | | |
| Alhydrogel Titer: | 10 | 10 | 20 | 410 | 676 | 1631 | 3510 |
| Alhydrogel + CpG | 10 | 13 | *136 | *2163 | *5076 | *9057 | *27971 |

TABLE 47-continued

Immunogenicity of Adjuvanted Mutant Toxin Drug Substances in NHPs (50% Neutralization Titer)

| | Week: | | | | | | |
|---|---|---|---|---|---|---|---|
| | Wk 0 | Wk 2 | Wk 4 | Wk 6 | Wk 12 | Wk 25 | Wk 33 |
| Titer: | | | | | | | |
| ISCOMATRIX Titer: | 10 | 10 | *269 | *5325 | *9161 | *19479 | *25119 |

The dose of mutant toxin A drug substance and mutant toxin B drug substance administered, in the presence of ISCOMATRIX or Alh/CpG adjuvants, on neutralizing antitoxin antibody titers generated in NHPs was also evaluated. In one study, NHPs were administered a low (10 µg) or a high (100 µg) dose of each mutant toxin drug substance formulated in ISCOMATRIX. Responses were compared at each time point after immunization. As shown in Table 48, antitoxin neutralization titers were robust in both treatment groups. The antitoxin A titers were nearly equivalent at most time points between the low dose and high dose groups, while there was a trend for the antitoxin B titers to be higher in the high dose group.

TABLE 48

Neutralizing Antitoxin Titers in NHPs Following Immunization with Either 10 µg or 100 µg of Each of Mutant Toxin Drug Substance and Mutant Toxin Drug Substance Administered with ISCOMATRIX (50% Neutralization Titer)

| | Week | | | | | | |
|---|---|---|---|---|---|---|---|
| | Wk 0 | Wk 2 | Wk 3 | Wk 4 | Wk 6 | Wk 8 | Wk 12 |
| Antitoxin A (Merck/Medarex protective range: 666-6,667 for antitoxin A) | | | | | | | |
| 10 µg Titer: | 11 | 585 | 3522 | 4519 | 19280 | 10225 | 12084 |
| 100 µg Titer: | 11 | 400 | 1212 | 2512 | 9944 | 10283 | 18337 |
| Antitoxin B (Merck/Medarex protective range: 222-2,222 for antitoxin B) | | | | | | | |
| 10 µg Titer: | 10 | 10 | 112 | 266 | 3710 | 2666 | 7060 |
| 100 µg Titer: | 10 | 10 | 303 | 469 | 6016 | 4743 | 20683 |

As shown in Table 48, Cynomolgus macaques (n=5) were immunized IM at weeks 0, 2, and 4 with 10 µg or 100 µg each of mutant toxin A drug substance and mutant toxin B drug substance formulated with 45 U of ISCOMATRIX. Sera were collected at each time point and analyzed in the toxin neutralization assay for functional antitoxin activity. GMTs are listed in the table. The protective titer range represents the neutralizing antibody titer range which correlates to significant reduction in recurrence of *C. difficile* infection in the Merck/Medarex mAb therapy trial.

In an effort to enhance the kinetics of antitoxin B responses, NHPs were immunized with a constant dose of mutant toxin A drug substance (10 µg) that was mixed with an increasing dose of mutant toxin B drug substance (10, 50, or 100 µg) in the presence of ISCOMATRIX or Alh/CpG adjuvants. Regardless of adjuvant, there was a trend for groups that received higher doses of mutant toxin B drug substance (either 50 or 100 µg) to induce higher antitoxin B neutralizing responses in comparison to the 10 µg dose of mutant toxin B drug (Table 50, marked by * to indicate statistically significant increases). This trend was observed at most time points after the final immunization. However, in some cases, antitoxin A neutralizing responses showed a statistically significant decrease (marked by ^ in Table 49) when the amount of mutant toxin B was increased.

As shown in Table 49 and Table 50, NHPs (10 per group) were immunized IM at weeks 0, 2, and 4 with different ratios of mutant toxin A drug substance and mutant toxin B drug substance (10 µg of mutant toxin A drug substance plus either 10, 50, or 100 µg of mutant toxin B drug substance; designated 10A:10B, 10A:50B and 10A:100B, respectively, in Table 49 and Table 50), formulated with ISCOMATRIX (45Upper dose) or with Alh/CpG/ (250 µg/500 µg per dose). Table 49 shows Antitoxin A titers. Table 50 shows Antitoxin B titers. GMTs are listed in the tables. The protective titer range represents the neutralizing antibody titer range which correlates to significant reduction in recurrence of *C. difficile* infection in the Merck mAb therapy trial. The symbol ^, represents statistically significant decrease in neutralizing titers (p<0.05) compared to the 10A: 10B group. The asterisk symbol, *, represents statistically significant increase in neutralizing titers (p<0.05) compared to the 10A: 10B group.

TABLE 49

Neutralizing Antitoxin Titers in NHPs Following Immunization with 10 µg Mutant Toxin A Drug Substance Combined with 10, 50, or 100 µg Mutant Toxin B Drug Substance using ISCOMATRIX or Alh/CpG as Adjuvants (50% Neutralization Titer)

| | Week: | | | | | | |
|---|---|---|---|---|---|---|---|
| | Wk 0 | Wk 2 | Wk 4 | Wk 6 | Wk 12 | Wk 25 | Wk 33 |
| Antitoxin A (Merck/Medarex protective range: 666-6,667 for antitoxin A) ISCOMATRIX | | | | | | | |
| 10A:10B Titer: | 25 | 1283 | 3835 | 19511 | 12904 | 6992 | 7971 |
| 10A:50B Titer: | 29 | 906 | 2917 | 16126 | ^7756 | ^4208 | 5965 |
| 10A:100B Titer: | 20 | 982 | 2310 | ^5034 | ^5469 | ^4007 | 3780 |
| Antitoxin A (Merck/Medarex protective range: 666-6,667 for antitoxin A) Alh/CpG | | | | | | | |
| 10A:10B Titer: | 17 | 1004 | 2162 | 15989 | 7179 | 5049 | 7023 |
| 10A:50B Titer: | 20 | 460 | 1728 | 16600 | 6693 | 6173 | 8074 |
| 10A:100B Titer: | 27 | ^415 | 1595 | 13601 | 6465 | 5039 | 6153 |

TABLE 50

Neutralizing Antitoxin Titers in NHPs Following Immunization with 10 μg Mutant Toxin A Drug Substance Combined with 10, 50, or 100 μg Mutant Toxin B Drug Substance using ISCOMATRIX or Alh/CpG as Adjuvants (50% Neutralization Titer)

| | Week: | | | | | | |
|---|---|---|---|---|---|---|---|
| | Wk 0 | Wk 2 | Wk 4 | Wk 6 | Wk 12 | Wk 25 | Wk 33 |
| Antitoxin B (Merck/Medarex protective range: 222-2,222 for antitoxin B) | | | | | | | |
| ISCO-MATRIX Titer: | 10 | 10 | 269 | 5325 | 9161 | 19479 | 25119 |
| Titer: | 13 | *20 | *604 | 4861 | 10801 | 20186 | *57565 |
| Titer: | 10 | *23 | *862 | *10658 | 10639 | *33725 | *56073 |
| Antitoxin B (Merck/Medarex protective range: 222-2,222 for antitoxin B) | | | | | | | |
| Alh/CpG Titer: | 10 | 13 | 136 | 2163 | 5076 | 9057 | 27971 |
| Titer: | 10 | 15 | *450 | *5542 | *9843 | 15112 | 50316 |
| Titer: | 11 | 17 | *775 | *13533 | *11708 | *17487 | 26600 |

Example 43

Five-Week Repeat-Dose IM Toxicity Study with an Immunogenic Composition in Cynomolgus Monkeys, with a 4-Week Recovery Period The 5-week IM repeat-dose toxicity study with PF-06425095 (an immunogenic composition including triple mutant toxin A drug substance and triple mutant toxin B drug substance in a combination with adjuvants aluminum hydroxide and CpG 24555) in Cynomolgus monkeys was conducted to assess the potential toxicity and immunogenicity of *C. difficile* triple mutant toxin A drug substance and triple mutant toxin B drug substance in a combination with the adjuvants aluminum hydroxide and CpG 24555 (PF-06425095). PF-06425095 at 0.2 or 0.4 mg/dose triple mutant toxin A drug substance and triple mutant toxin B drug substance (low- and high-dose immunogenic composition groups, respectively), 0.5 mg aluminum as aluminum hydroxide, and 1 mg CpG 24555 and the adjuvant combination alone (aluminum hydroxide+CpG 24555; PF-06376915) were administered IM to cynomolgus monkeys (6/sex/group) as a prime dose followed by 3 booster doses (Days 1, 8, 22, and 36). A separate group of animals (6/sex) received 0.9% isotonic saline at an approximate pH of 7.0. The immunogenic composition vehicle was composed of 10 mM Tris buffer at pH 7.4, 4.5% trehalose dihydrate, and 0.1% polysorbate 80. The adjuvant control vehicle was composed of 10 mM histidine buffer with 60 nM NaCl at pH 6.5. The total dose volume was 0.5 mL per injection. All doses were administered into the left and/or right quardriceps muscle. Selected animals underwent a 4-week dose-free observation period to assess for reversibility of any effects observed during the dosing phase of the study.

There were no adverse findings in this study. PF-06425095 was well-tolerated and produced only local inflammatory reaction without evidence of systemic toxicity. During the dosing phase, dose-dependent increases from pretest in fibrinogen (23.1% to 2.3×) on Days 4 and 38 and C-reactive protein on Days 4 (2.1× to 27.5×) and 38 (2.3× to 101.5×), and globulin (11.1% to 24.1%) on Day 36 and/or 38, were seen in immunogenic composition-treated groups and were consistent with the expected inflammatory response to administration of an adjuvanted immunogenic composition.

The increases in fibrinogen and C-reactive protein noted on Day 4 had partially recovered by Day 8 with increases in fibrinogen (25.6% to 65.5%) and C-reactive protein (4.5× and 5.6×) in the high-dose immunogenic composition group only. Increases in interleukin (IL)-6 were observed in the low- and high-dose immunogenic composition groups on Day 1, Hour 3 (8.3× to 127.2× individual values Day 1, Hour 0, dose responsive) and Day 36, Hour 3 (9.4× to 39.5× individual values Day 36, Hour 0). There were no changes observed in the other cytokines (IL-10, IL-12, Interferon-Inducible Protein (IP-10), and Tumor Necrosis Factor α (TNF-α). Increases in these acute phase proteins and cytokine were part of the expected normal physiologic response to the administration of foreign antigen. There were no PF 06425095-related or adjuvant-related alterations in these clinical pathology parameters in the recovery phase (cytokines were not evaluated during the recovery phase). In addition, there were localized changes at the injection sites, which were of similar incidence and severity in the adjuvant control group and the low- and high-dose immunogenic composition groups; hence, they were not directly related to PF-06425095. During the dosing phase, the changes included minimal to moderate chronic-active inflammation that was characterized by separation of muscle fibers by infiltrates of macrophages, which often contained basophilic granular material (interpreted as aluminum-containing adjuvant), lymphocytes, plasma cells, neutrophils, eosinophils, necrotic debris, and edema. The basophilic granular material was also present extracellularly within these foci of chronic-active inflammation. At the end of the recovery phase, there was minimal to moderate chronic inflammation and mononuclear cell infiltrate, and minimal fibrosis. These injection site findings represent a local inflammatory response to the adjuvant. Other microscopic changes included minimal to moderate increased lymphoid cellularity in the iliac (draining) lymph node and minimal increased cellularity in germinal centers in the spleen that were noted during the dosing phase in the adjuvant control group and the low- and high-dose immunogenic composition groups. At the end of the recovery phase, these microscopic findings were of lower severity. These effects represent an immunologic response to antigenic stimulation, and were a pharmacologic response to the adjuvant or PF-06425095. There was no test article-related increase in anti-DNA antibodies.

Based on absence of adverse findings, the no observed adverse effect level (NOAEL) in this study is the high-dose immunogenic composition group (0.4 mg of triple mutant toxin A drug substance and triple mutant toxin B drug substance/dose as PF-06425095) administered as two 0.5 mL injections for four doses.

Example 44

Efficacy of Seropositive NHP Sera Passively Transferred to Hamsters

Groups of 5 Syrian golden hamsters were administered an oral dose of clindamycin antibiotic (30 mg/kg) to disrupt normal intestinal flora. After five days, the hamsters were challenged with an oral dose of wild type *C. difficile* spores (630 strain, 100 cfu per animal), and administered intraperitoneally (IP) with NHP sera according to Table 51. Without being bound by mechanism or theory, disease symptoms following challenge with the spores typically manifest beginning about 30-48 hours post-challenge.

The NHP sera that were administered to the hamsters were pooled from NHP serum samples exhibiting the highest titer (anti-toxin A sera and anti-toxin B sera) following three immunizations with mutant toxin A drug substance and mutant toxin B drug substance (10:10, 10:50, and 10:100 A:B ratios), formulated with ISCOMATRIX (see Example 42, Table 49, and Table 50). The NHP sera were collected from timepoints at weeks 5, 6, and 8 (immunizations occurred at weeks 0, 2, and 4), as described in Examine 42. Results are shown in Tables 52-54 below. The symbol "+" indicates a Geometric mean (GM) in ( ) that does not include animal #3, non-responder. "*TB" represents terminal bleed, the day the animal was euthanized, which is not the same for all animals.

TABLE 51

Experimental design

| Group | Administered composition | No. animals | Route | Schedule |
|---|---|---|---|---|
| 1 "1 dose" | Seropositive NHP sera (unconcentrated) | 5 | IP | Challenge Day 0 Dose day 0 Bleed days 0, 1, 2, TB on day 11 |
| 2 "2 dose" | Seropositive NHP sera (unconcentrated) | 5 | IP | Challenge Day 0 Dose days 0, 1 Bleed days 0, 1, 2, TB on day 11 |

TABLE 52

Anti-toxin A Neutralization Titers in Hamster Sera Following 1 or 2 IP doses of NHP Sera (50% Neutralization Titer in RLU)

| | Day | Hamster 1 | Hamster 2 | Hamster 3 | Hamster 4 | Hamster 5 | GM | SE |
|---|---|---|---|---|---|---|---|---|
| 1 dose | D0 | 50 | 50 | 50 | 50 | 50 | 50 | 0 |
| | D1 | 2877 | 4008 | 2617 | 4917 | 1872 | 3081 | 538 |
| | D2 | 1983 | 3009 | 2750 | 2902 | 1117 | 2214 | 357 |
| | TB* | 3239 | 537 | 155 | 977 | 972 | 762 | 538 |
| | | (d4) | (d9) | (d11) | (d9) | (d2) | | |
| 2 dose | D0 | 50 | 50 | 50 | 50 | 50 | 50 | 0 |
| | D1 | 1154 | 2819 | 50 | 429 | 1174 | 606 $(1131)^+$ | 475 |
| | D2 | 4119 | 4674 | 1899 | 545 | | 2113 | 862 |
| | TB* | 1236 | 1267 | 1493 | 50 | 1877 | 738 | 306 |
| | | (d9) | (d8) | (d4) | (d11) | (d9) | | |

Input NHP sera = 41976

TABLE 53

Anti-toxin B Neutralization Titers in Hamster Sera Following 1 or 2 IP doses of NHP Sera (50% Neutralization Titer in RLU)

| | Day | Hamster 1 | Hamster 2 | Hamster 3 | Hamster 4 | Hamster 5 | GM | SE |
|---|---|---|---|---|---|---|---|---|
| 1 dose | D0 | 50 | 50 | 50 | 50 | 50 | 50 | 0 |
| | D1 | 1846 | 4254 | 1347 | 5178 | 406 | 1859 | 904 |
| | D2 | 992 | 1795 | 2585 | 2459 | 1145 | 1669 | 327 |
| | TB* | 1744 | 50 | 50 | 265 | 544 | 229 | 317 |
| | | (d4) | (d9) | (d11) | (d9) | (d2) | | |
| 2 dose | D0 | 50 | 50 | 50 | 50 | 50 | 50 | 0 |
| | D1 | 1189 | 2229 | 50 | 550 | 3920 | 778 $(1546)^+$ | 687 |
| | D2 | 2288 | 2706 | 1452 | 287 | | 1268 | 477 |
| | TB* | 301 | 694 | 682 | 50 | 1334 | 394 | 217 |
| | | (d9) | (d8) | (d4) | (d11) | (d9) | | |

Input NHP sera = 23633

TABLE 54

Percentage of hamsters protected from severe CDAD following 1 or 2 IP doses of NHP sera

| | Days post-infection | | | | | | |
|---|---|---|---|---|---|---|---|
| | 0 | 2 | 4 | 6 | 8 | 10 | 11 |
| 1 dose NHP Sera | 100% | 80% | 60% | 60% | 60% | 20% | 20% |
| 2 dose NHP Sera | 100% | 100% | 80% | 80% | 60% | 20% | 20% |
| Placebo | 100% | 75% | 50% | 25% | 0% | n/a | n/a |

In another study, Syrian golden hamsters were administered an oral dose of clindamycin antibiotic (30 mg/kg) to disrupt normal intestinal flora. After five days, the hamsters were challenged with an oral dose of wild type *C. difficile* spores (630 strain, 100 cfu per animal), and administered intraperitoneally (IP) NHP sera according to Table 55. Without being bound by mechanism or theory, disease symptoms following challenge with the spores typically manifest beginning about 30-48 hours post-challenge.

The NHP sera that were administered to the hamsters were pooled from samples collected from NHPs following three immunizations with mutant toxin A drug substance and mutant toxin B drug substance (10:10, 10:50, and 10:100 A:B ratios), formulated with Alhydrogel and CpG 24555 (see Example 42, Table 49, and Table 50). The NHP sera were collected from timepoints at weeks 5, 6, 8, and 12 as described in Examine 42 (NHPs were immunized on weeks 0, 2, and 4). Results are shown in Tables 56-59 below. Sera from the hamsters were further investigated to determine inhibitory concentration ($IC_{50}$) value, which were determined using the toxin neutralization assay described above. The level of toxin-neutralizing antibodies induced in hamsters by the inventive *C. difficile* immunogenic composition is comparable to the serum antibody levels in the Merck/Medarex trial subjects who appeared to be protected from recurrences of CDAD.

TABLE 55

Experimental Design

| Group | Administered Composition | No. | Route | Schedule |
|---|---|---|---|---|
| 1 | Seropositive NHP sera | 5 | IP | Challenge D 0 Dose D 0, 1, 3, 5, 7 |
| 2 | Seropositive NHP sera | 5 | IP | no challenge Dose D 0, 1, 3, 5, 7, |
| 3 | Seropositive NHP sera | 10 | IP | Challenge D 0 Dose D 0, 1, 3, 5, 7 |
| 4 | Placebo | 5 | IM | Challenge D 0 |

TABLE 56

Anti-toxin A Neutralization Titers[a] in Hamster Sera Following 1 or 2 IP doses of NHP Sera (50% Neutralization Titer in RLU)

| Day | Challenged (Groups 1 and 3) | Not Challenged (Group 2) | p Value |
|---|---|---|---|
| 0 | 11 | 12 | 0.5933 |
| 1 | 380 | 720 | 0.034* |
| 3 | 666 | 1220 | 0.0256* |
| 5 | 864 | 1367 | 0.0391* |

TABLE 56-continued

Anti-toxin A Neutralization Titers[a] in Hamster Sera Following 1 or 2 IP doses of NHP Sera (50% Neutralization Titer in RLU)

| Day | Challenged (Groups 1 and 3) | Not Challenged (Group 2) | p Value |
|---|---|---|---|
| 7 | 564 | 1688 | 0.0411* |
| 11 | 263 | 1281 | 0.001* |

Input NHP sera pool = 9680
[a]titers expressed as geometric means for each group (n = 15 at day 0 for "challenged" group, n = 5 for "not challenged" group)
Merck/Medarex protective range: 666-6,667 for antitoxin A
The asterisk "*" indicates a significant difference.

TABLE 57

Anti-toxin B Neutralization Titers[a] in Hamster Sera Following 1 or 2 IP doses of NHP Sera (50% Neutralization Titer in RLU)

| Day | Challenged (Groups 1 and 3) | Not Challenged (Group 2) | p Value |
|---|---|---|---|
| 0 | 10 | 10 | 0.3343 |
| 1 | 465 | 828 | 0.0579 |
| 3 | 765 | 1400 | 0.0273* |
| 5 | 941 | 1734 | 0.0226* |
| 7 | 611 | 1877 | 0.0498* |
| 11 | 194 | 1436 | 0.0047* |

Input NHP sera pool = 19631
[a]titers expressed as geometric means for each group (n = 15 at day 0 for "challenged" group, n = 5 for "not challenged" group)
Merck/Medarex protective range: 222-2,222 for antitoxin B
The asterisk "*" indicates a significant difference.

TABLE 58

Percentage of hamsters protected from severe CDAD following IP dose of NHP sera

| | Days post-infection | | | | | | |
|---|---|---|---|---|---|---|---|
| | 0 | 2 | 4 | 6 | 8 | 10 | 11 |
| Groups 1 and 3 | 100% | 73% | 53% | 53% | 47% | 33% | 33% |
| Placebo (Group 2) | 100% | 50% | 0% | | | | |

TABLE 59

$IC_{50}$ values from Toxin-specific 50% Neutralization Titers

| | | $IC_{50}$ of Anti Toxin A Day of Post Dose | | | | | | $IC_{50}$ of Anti Toxin B Day of Post Dose | | | | | |
|---|---|---|---|---|---|---|---|---|---|---|---|---|---|
| | Animal ID | 0 | 1 | 3 | 5 | 7 | 11 | Animal ID | 0 | 1 | 3 | 5 | 7 | 11 |
| Challenged | 1-1 | 10 | 50 | 338 | died D4 | | | 1-1 | 10 | 50 | 254 | died D4 | | |
| | 1-2 | 10 | 614 | 579 | 777 | 605 | 192 | 1-2 | 10 | 720 | 659 | 896 | 475 | 157 |
| | 1-3 | 10 | 710 | 1035 | 845 | 548 | Died D10 | 1-3 | 10 | 867 | 1017 | 988 | 694 | |
| | 1-4 | 10 | 850 | 588 | 942 | 1116 | 296 | 1-4 | 10 | 1158 | 555 | 1158 | 1806 | 250 |
| | 1-5 | 10 | 780 | 895* | | | | 1-5 | 10 | 910 | 687* | | | |
| | 3-1 | 10 | 647 | Died D2 | | | | 3-1 | 10 | 598 | Died D2 | | | |
| | 3-2 | 10 | 331 | Died D2 | | | | 3-2 | 10 | 290 | Died D2 | | | |
| | 3-3 | 10 | 660 | 1273 | 849 | 692 | 640 | 3-3 | 10 | 717 | 1623 | 870 | 791 | 574 |
| | 3-4 | 10 | 536 | 493 | 1102 | 1314 | Died D9 | 3-4 | 10 | 618 | 598 | 977 | 1478 | Died D9 |
| | 3-5 | 10 | 817 | 807 | 774 | 1077 | 187 | 3-5 | 10 | 772 | 1260 | 850 | 913 | 243 |
| | 3-6 | 10 | 117 | 649 | 803 | 50 | 186 | 3-6 | 10 | 1038 | 773 | 883 | 50 | 50 |
| | 3-7 | 10 | 50 | Died D2 | | | | 3-7 | 10 | 50 | Died D2 | | | |

TABLE 59-continued

IC$_{50}$ values from Toxin-specific 50% Neutralization Titers

| | Animal ID | IC$_{50}$ of Anti Toxin A Day of Post Dose | | | | | | Animal ID | IC$_{50}$ of Anti Toxin B Day of Post Dose | | | | | |
|---|---|---|---|---|---|---|---|---|---|---|---|---|---|---|
| | | 0 | 1 | 3 | 5 | 7 | 11 | | 0 | 1 | 3 | 5 | 7 | 11 |
| | 3-8 | 10 | 149 | 659 | 650* | | | 3-8 | 10 | 121 | 1010 | 517* | | |
| | 3-9 | 30 | 797 | 1170* | | | | 3-9 | 10 | 1008 | 1720* | | | |
| | 3-10 | 10 | 792 | Died D2 | | | | 3-10 | 10 | 835 | Died D2 | | | |
| | GeoMean | 11 | 380 | 666 | 864 | 564 | 263 | GeoMean | 10 | 465 | 765 | 941 | 611 | 194 |
| Not | Std Error | 1 | 78 | 86 | 41 | 163 | 88 | Std Error | 0 | 94 | 125 | 38 | 224 | 88 |
| Challenged | 2-1 | 10 | 697 | 1634 | 1597 | 2219 | 1709 | 2-1 | 10 | 890 | 1777 | 1910 | 3229 | 1355 |
| | 2-2 | 10 | 779 | 1207 | 1322 | 1755 | 1327 | 2-2 | 10 | 939 | 1378 | 1564 | 1897 | 1379 |
| | 2-3 | 10 | 581 | 669 | 722 | 1401 | 1118 | 2-3 | 10 | 828 | 837 | 865 | 1484 | 1404 |
| | 2-4 | 26 | 856 | 1540 | 1875 | 1830 | 1826 | 2-4 | 10 | 748 | 1780 | 2939 | 1880 | 2650 |
| | 2-5 | 10 | 715 | 1331 | 1668 | 1374 | 744 | 2-5 | 10 | 752 | 1475 | 2064 | 1364 | 880 |
| | GeoMean | 12 | 720 | 1220 | 1367 | 1688 | 1281 | GeoMean | 10 | 828 | 1400 | 1734 | 1877 | 1436 |
| | Std Error | 3 | 46 | 169 | 199 | 156 | 197 | Std Error | 0 | 38 | 173 | 338 | 332 | 296 |

*= deceased on that day

Example 45

Characterization of Mutant Toxin Drug Substances

The primary structure of triple mutant toxin A is shown in SEQ ID NO: 4. The $NH_2$-terminal Met residue at position 1 of SEQ ID NO: 4 is originated from the initiation codon of SEQ ID NO: 12 and is absent in isolated protein (e.g., see SEQ ID NO: 84). Accordingly, in Example 12 to Example 45, "SEQ ID NO: 4" refers to SEQ ID NO: 4 wherein the initial methionine (at position 1) is absent. Both purified triple mutant toxin A (SEQ ID NO: 4) (Drug Substance Intermediate—Lot L44993-132) and EDC/NHS treated triple mutant toxin A (SEQ ID NO: 4)("mutant toxin A Drug Substance"—Lot L44898-012) displayed a single $NH_2$-terminal sequence starting at SLISKEELIKLAYSI (positions 2-16 of SEQ ID NO: 4).

The primary structure of triple mutant toxin B is shown in SEQ ID NO: 6. The $NH_2$-terminal Met residue at position 1 of SEQ ID NO: 6 is originating from the initiation codon and is absent in isolated protein (e.g., see SEQ ID NO: 86). Accordingly, in Example 12 to Example 45, "SEQ ID NO: 6" refers to SEQ ID NO: 6 wherein the initial methionine (at position 1) is absent. Both purified triple mutant toxin B (SEQ ID NO: 6) (Drug Substance Intermediate—Lot 010) and EDC/NHS treated triple mutant toxin B (SEQ ID NO: 6)("mutant toxin B Drug Substance"—Lot L44906-153) displayed a single $NH_2$-terminal sequence starting at SLVNRKQLEKMANVR (positions 2-16 of SEQ ID NO 6).

Circular dichroism (CD) spectroscopy was used to assess secondary and tertiary structure of triple mutant A (SEQ ID NO: 4) and mutant toxin A drug substance. CD spectroscopy was also used to assess secondary and tertiary structure of the triple mutant toxin B (SEQ ID NO: 6) and the mutant toxin B drug substance. CD spectroscopy was also used to assess potential effects of pH on structure. The effect of EDC treatment on triple mutant toxin A was analyzed by comparing CD data obtained for mutant toxin A drug substance to the data obtained for triple mutant toxin A. The effects of EDC treatment on triple mutant toxin B (SEQ ID NO: 6) were analyzed by comparing CD data obtained for mutant toxin B drug substance to the data obtained for triple mutant toxin B.

Mutant toxin A drug substance far-UV CD data were obtained at various pH. Spectra recorded at pH 5.0-7.0 are indicative of high proportion of α-helices in the secondary structure, suggesting that polypeptide backbone of the protein adopts well-defined conformation dominated by α-helices.

Near-UV CD spectra of mutant toxin A drug substance were also obtained. Strong negative ellipticity between 260 and 300 nm is an indication that aromatic side chains are in the unique rigid environment, i.e. mutant toxin A drug substance possesses tertiary structure. In fact, characteristic features arising from individual types of aromatic side chains can be distinguished within the spectrum: shoulder at ~290 nm and largest negative peak at ~283 nm are due to absorbance of the polarized light by ordered tryptophan side chains, negative peak at 276 nm is from the tyrosine side chains, and minor shoulders at 262 and 268 nm are indicative of the phenylalanine residues participating in tertiary contacts. Far- and near-UV results provide evidence that mutant toxin A drug substance retains compactly folded structure at physiological pH. Nearly identical far- and near-UV CD spectra observed at pH 5.0-7.0 indicate that no detectable structural changes are taking place within this pH range. CD data could not be collected at pH 3.0 and 4.0, since the protein was insoluble at these pH points. In comparing far- and near-UV CD spectra of mutant toxin A drug substance with those of the triple mutant toxin A, spectra of both proteins are essentially identical under all of the experimental conditions studied, indicating that EDC treatment had no detectable effects on secondary and tertiary structure of the triple mutant toxin A. This finding is in agreement with the gel-filtration and analytical ultracentrifugation results, which show no detectable changes in Stokes radii and sedimentation/frictional coefficients, respectively.

Mutant toxin A drug substance (as well as triple mutant toxin A) contains 25 tryptophan residues that are spread throughout the primary sequence and can serve as convenient intrinsic fluorescence probes. Fluorescence emission spectra of mutant toxin A drug substance between 300 and 400 nm as a function of temperature were obtained. At 6.8° C. mutant toxin A drug substance shows characteristic tryptophan fluorescence emission spectrum upon excitation at 280 nm. Fluorescence emission maximum is observed at ~335 nm, indicating that tryptophan residues are in non-polar environment, typical of protein interiors rather than of polar aqueous environments. The fluorescence emission spectra results, together with the results of the CD experiments presented in this report, confirm that mutant toxin A drug substance retains compact folded structure.

Fluorescence of the extrinsic probe 8-anilino-1-naphtalene sulfonic acid (ANS) was used to characterize possible conformational changes in mutant toxin A drug substance and triple mutant toxin A upon changes in pH. As can be seen from the results, there is essentially no increase in ANS fluorescence intensity when either mutant toxin A drug substance or triple mutant toxin A are titrated with the probe at pH 7.0, suggesting that no hydrophobic surfaces are exposed on the proteins under these conditions. Shifting pH to 2.6 leads to a dramatic increase in ANS fluorescence quantum yield upon increase in probe's concentration, until fluorescence quantum yield reaches apparent saturation. This increase in ANS fluorescence quantum yield indicates that at low pH (2.6), both mutant toxin A drug substance and triple mutant toxin A undergo pH-induced conformational change that exposes hydrophobic surfaces. Such conformational changes indicate that EDC-induced modification and inactivation of triple mutant toxin A did not restrict conformational plasticity of mutant toxin A drug substance (DS).

Effect of EDC treatment on hydrodynamic properties of triple mutant toxin A was evaluated using size-exclusion chromatography on a G4000 SWXL column. Mutant toxin A drug substance and triple mutant toxin A were injected onto the G4000 SWXL column equilibrated at pH 7.0, 6.0, and 5.0. The data indicate that no differences in the Stoke's radius of mutant toxin A drug substance and triple mutant toxin A can be detected using size exclusion chromatography. Therefore, EDC treatment has not dramatically affected hydrodynamic properties and, correspondingly, overall molecular shape of the triple mutant toxin A.

Further analysis of triple mutant toxin A and mutant toxin A drug substance was performed using multi-angle laser light scattering (MALLS) technique. Treatment of triple mutant toxin A with EDC resulted in generation of heterogeneous mixture composed of various multimeric and monomeric species. Such heterogeneity reflects introduction of a large number of EDC-induced inter- and intra-molecular covalent bonds between carboxyls and primary amines of the protein.

Obtained data provide physical and chemical characteristics of triple mutant toxin A and mutant toxin A drug substance (triple mutant toxin A treated with EDC) and describe the key features of their primary, secondary, and tertiary structure. Generated data demonstrate that treatment of triple mutant toxin A with EDC resulted in covalent modification of its polypeptide chain but did not affect secondary and tertiary structures of the protein. Treatment with EDC leads to intra- and intermolecular cross-linking. The biochemical and biophysical parameters obtained for mutant toxin A drug substance (as well as triple mutant toxin A) are presented in Table 60.

TABLE 60

Major Biochemical and Biophysical Parameters Obtained for Triple Mutant Toxin A (SEQ ID NO: 4) and Mutant Toxin A Drug Substance

| Parameter | Triple Mutant toxin A (SEQ ID NO: 4) | Mutant Toxin A Drug Substance |
|---|---|---|
| Number of amino acid residues | 2709 | 2709 |
| N-terminal sequence | SLISKEELIKLAYSI (positions 2-16 of SEQ ID NO: 4) | SLISKEELIKLAYSI (positions 2-16 of SEQ ID NO: 4) |
| Mol mass (from AA sequence) | 308 kDa | 308 kDa |
| Mol mass (from SEC-MALLS) | 299 kDa | 300 kDa and 718-1139 kDa |
| Extinction coefficient at 280 nm | 1.292 or 1.275 (mg/ml)$^{-1}$cm$^{-1}$ | 1.292 or 1.275 275 (mg/ml)$^{-1}$cm$^{-1}$ |
| Theoretical pI | 5.57 | ND |
| Partial specific mol volume at 20° C. | 0.735 cm$^3$/g | 0.735 cm$^3$/g |
| Anhydrous volume/monomer | 3.8 × 10$^{-19}$cm$^3$ | 3.8 × 10$^{-19}$cm$^3$ |
| Sedimentation coefficient/monomer | 9.2S | 9.2S |
| Frictional coefficient ratio (f/f$_0$) | 1.69 | 1.69 |
| Stokes radius/monomer | 78.4 ± 1.1 | 77.9 |
| Fluorescence max (λex = 280 nm) | 334-335 nm | 334-335 nm |

TABLE 60-continued

Major Biochemical and Biophysical Parameters Obtained for Triple Mutant Toxin A (SEQ ID NO: 4) and Mutant Toxin A Drug Substance

| Parameter | Triple Mutant toxin A (SEQ ID NO: 4) | Mutant Toxin A Drug Substance |
|---|---|---|
| Near-UV CD spectrum minima | 284 nm and 278 nm | 284 nm and 278 nm |
| Mean res ellipticity at 284 & 278 nm | −138 ± 7 & −130 ± 7 | −138 ± 8 & 131 ± 10 |
| Mean res ellipticity at 222 nm | −8989 ± 277 | −7950 ± 230 |
| DSC unfolding transitions maxima (PBS, pH 7.4) | 47.3° C. and 53.6° C. | 47.9 ± 0.2° C. and 54.1 ± 0.2° C. |

Mutant toxin B drug substance far-UV CD data were obtained at various pH. Spectra recorded at pH 5.0-7.0 are indicative of high proportion of α-helices in the secondary structure, suggesting that polypeptide backbone of the protein adopts well-defined conformation dominated by α-helices.

Near-UV CD spectra of mutant toxin B drug substance were also obtained. Strong negative ellipticity between 260 and 300 nm is an indication that aromatic side chains are in the unique rigid environment, i.e. mutant toxin B drug substance possesses tertiary structure. In fact, characteristic features arising from individual types of aromatic side chains can be distinguished within the spectrum: shoulder at ~290 nm and largest negative peak at ~283 nm are due to absorbance of the polarized light by ordered tryptophan side chains, negative peak at 276 nm is from the tyrosine side chains, and minor shoulders at 262 and 268 nm are indicative of the phenylalanine residues participating in tertiary contacts. Far- and near-UV CD spectra provide evidence that mutant toxin B drug substance retains compactly folded structure at physiological pH. Very similar far- and near-UV CD spectra observed at pH 5.0-7.0 indicate that no detectable secondary or tertiary structural changes are taking place within this pH range. CD data could not be collected at pH 3.0 and 4.0, since the protein was insoluble at these pH points.

In comparing far- and near-UV CD spectra of mutant toxin B drug substance with those of the triple mutant toxin B, spectra of both proteins are very similar between pH 5.0 and 7.0, indicating that EDC treatment had no detectable effects on secondary and tertiary structure of the protein.

Triple mutant toxin B contains 16 tryptophan residues that are spread throughout the primary sequence and can serve as convenient intrinsic fluorescence probes. Fluorescence emission spectra of mutant toxin B drug substance between 300 and 400 nm as a function of temperature were obtained. At 7° C. mutant toxin B drug substance shows characteristic tryptophan fluorescence emission spectrum upon excitation at 280 nm. Fluorescence emission maximum is observed at ~335 nm, indicating that tryptophan residues are in non-polar environment, typical of protein interiors rather than of polar aqueous environments. This result, together with the results of the CD experiments (see above), confirm that mutant toxin B drug substance retains compact folded structure.

Fluorescence of the extrinsic probe 8-anilino-1-naphtalene sulfonic acid (ANS) was used to characterize possible conformational changes in mutant toxin B drug substance and triple mutant toxin B upon changes in pH. As can be seen from the results, there is essentially no increase in ANS fluorescence intensity when either mutant toxin B drug substance or triple mutant toxin B are titrated with the probe at pH 7.0, suggesting that no hydrophobic surfaces are exposed on the proteins under these conditions. Shifting pH to 2.6 leads to a dramatic increase in ANS fluorescence quantum yield upon increase in probe's concentration in the presence of mutant toxin B drug substance, until fluorescence quantum yield reaches apparent saturation. This increase in ANS fluorescence quantum yield indicates that at low pH (2.6), mutant toxin B drug substance undergoes pH-induced conformational change that exposes hydrophobic surfaces. Such conformational changes indicate that EDC-induced modification and inactivation of triple mutant toxin B did not restrict conformational plasticity of mutant toxin B drug substance (DS).

Effect of EDC treatment on hydrodynamic properties of triple mutant toxin B was evaluated using size-exclusion chromatography on a G4000 SWXL column. mutant toxin B drug substance and triple mutant toxin B were injected onto the G4000 SWXL column equilibrated at pH 7.0, 6.0, 5.0. The data indicate that no differences in the Stoke's radius of mutant toxin B drug substance and triple mutant toxin B can be detected using size-exclusion chromatography, therefore EDC treatment has not dramatically affected hydrodynamic properties and, correspondingly, overall molecular shape of the protein.

Further analysis of triple mutant toxin B and mutant toxin B drug substance was performed using multi-angle laser light scattering (MALLS) technique. Treatment of triple mutant toxin B with EDC resulted in generation of more heterogeneous mixture that is composed of various multimeric and monomeric species. Such heterogeneity reflects introduction of a large number of EDC-induced inter- and intra-molecular covalent bonds between carboxyls and primary amines of the protein.

Obtained data provide physical and chemical characteristics of triple mutant toxin B and mutant toxin B drug substance (triple mutant toxin B treated with EDC) and describe the key features of their primary, secondary, and tertiary structure. Generated data demonstrate that treatment of triple mutant toxin B with EDC resulted in covalent modification of its polypeptide chain but did not affect secondary and tertiary structures of the protein. Treatment with EDC leads to intra- and intermolecular cross-linking. The major biochemical and biophysical parameters obtained for mutant toxin B drug substance (as well as triple mutant toxin B) are presented in Table 61.

TABLE 61

Major Biochemical and Biophysical Parameters Obtained for Triple Mutant Toxin B (SEQ ID NO: 6) and Mutant Toxin B Drug Substance

| Parameter | Triple mutant toxin B (SEQ ID NO: 6) | Mutant Toxin B Drug Substance |
|---|---|---|
| Number of amino acid residues | 2365 | 2365 |
| N-terminal sequence | SLVNRKQLEKMANVR (positions 2-16 of SEQ ID NO: 6) | SLVNRKQLEKMANVR (positions 2-16 of SEQ ID NO: 6) |
| Mol mass (from AA sequence) | 269.5 kDa | 269.5 kDa |
| Mol mass (from SEC-MALLS) | 255 kDa and ~1,754 kDa | 264, 268, 706, and 2,211 kDa |
| Extinction coefficient at 280 nm | 1.067 (mg/ml)$^{-1}$cm$^{-1}$ | 1.067 (mg/ml)$^{-1}$cm$^{-1}$ |
| Theoretical pI | 4.29 | ND |
| Partial specific mol volume at 20° C. | 0.734 cm$^3$/g | 0.734 cm$^3$/g |
| Anhydrous volume/monomer | 3.3 x 10$^{-19}$cm$^3$ | 3.3 x 10$^{-19}$cm$^3$ |
| Sedimentation coefficient/monomer | 9.1 ± 0.2S | 9.4S |
| Frictional coefficient ratio (f/f$_0$) | 1.58 ± 0.03 | 1.53 |
| Stokes radius/monomer | 76.2 | 76.2 |
| Fluorescence max (λex = 280 nm) | 335 nm | 335 nm |
| Near-UV CD negative bands | 290, 283, 276, 268, 262 nm | 290, 283, 276, 268, 262 nm |
| Far-UV CD negative bands | 208 and 222 nm | 208 and 222 nm |
| DSC unfolding transition midpoints T$_{m1}$ and T$_{m2}$ (PBS, pH 7.0) | 48.8 ± 0.0° C. and 52.0 ± 0.1° C. | 48.2 ± 0.3° C. and 54.3 ± 0.2° C. |

ASPECTS OF THE INVENTION

The following clauses describe additional embodiments of the invention:

C1. An isolated polypeptide including the amino acid sequence set forth in SEQ ID NO: 4, wherein the methionine residue at position 1 is optionally not present, and wherein the polypeptide includes at least one amino acid side chain chemically modified by 1-ethyl-3-(3-dimethylaminopropyl) carbodiimide) (EDC) and N-Hydroxysuccinimide (NHS).

C2. An isolated polypeptide including the amino acid sequence set forth in SEQ ID NO: 6, wherein the methionine residue at position 1 is optionally not present, and wherein the polypeptide includes an amino acid side chain chemically modified by 1-ethyl-3-(3-dimethylaminopropyl) carbodiimide) (EDC) and N-Hydroxysuccinimide (NHS).

C3. The isolated polypeptide according to clause C1 or C2, wherein at least one side chain of an aspartic acid residue of the polypeptide or at least one side chain of a glutamic acid residue of the polypeptide is chemically modified by glycine.

C4. The isolated polypeptide according to any of clause C1-C3, wherein the polypeptide includes:

a) at least one crosslink between a side chain of an aspartic acid residue of the polypeptide and a side chain of a lysine residue of the polypeptide; and b) at least one crosslink between a side chain of a glutamic acid residue of the polypeptide and a side chain of a lysine residue of the polypeptide.

C5. The isolated polypeptide according to any of clause C1-C4, wherein the polypeptide includes a beta-alanine moiety linked to a side chain of at least one lysine residue of the polypeptide.

C6. The isolated polypeptide according to clause C4, wherein the polypeptide includes a glycine moiety linked to a side chain of an aspartic acid residue of the polypeptide or to a side chain of a glutamic acid residue of the polypeptide.

C7. An isolated polypeptide including the amino acid sequence set forth in SEQ ID NO: 4, wherein the methionine residue at position 1 is optionally not present, and wherein a side chain of at least one lysine residue of the polypeptide is linked to a beta-alanine moiety.

C8. An isolated polypeptide including the amino acid sequence set forth in SEQ ID NO: 6, wherein the methionine residue at position 1 is optionally not present, and wherein a side chain of at least one lysine residue of the polypeptide is linked to a beta-alanine moiety.

C9. The isolated polypeptide according to clause C7 or C8, wherein a side chain of a second lysine residue of the polypeptide is linked to a side chain of an aspartic acid residue or to a side chain of a glutamic acid residue.

C10. The isolated polypeptide according to any of clause C7-C9, wherein a side chain of an aspartic acid residue or a side chain of a glutamic acid residue of the polypeptide is linked to a glycine moiety.

C11. The isolated polypeptide as in any of clause C1-C10, wherein the polypeptide has an EC50 of at least about 100 μg/ml.

C12. An immunogenic composition including an isolated polypeptide having the amino acid sequence set forth in SEQ ID NO: 4, wherein the methionine residue at position 1 is optionally not present, and an isolated polypeptide having the amino acid sequence set forth in SEQ ID NO: 6, wherein the methionine residue at position 1 is optionally not present, and wherein the polypeptides have at least one amino acid side chain chemically modified by 1-ethyl-3-(3-dimethylaminopropyl) carbodiimide) (EDC) and N-Hydroxysuccinimide (NHS).

C13. The immunogenic composition according to clause C12, wherein the polypeptide includes at least one of any of:
a) at least one beta-alanine moiety linked to a side chain of a lysine residue of the polypeptide;
b) at least one crosslink between a side chain of a lysine residue of the polypeptide and a side chain of an aspartic acid residue; and
c) at least one crosslink between a side chain of a lysine residue of the polypeptide and a side chain of a glutamic acid residue.

C14. The immunogenic composition according to clause C12, wherein the polypeptides have an EC50 of at least about 100 μg/ml.

C15. An immunogenic composition including an isolated polypeptide having the amino acid sequence set forth in SEQ ID NO: 4, wherein the methionine residue at position 1 is optionally not present, and an isolated polypeptide having the amino acid sequence set forth in SEQ ID NO: 6, wherein the methionine residue at position 1 is optionally not present, and
a) wherein a side chain of at least one lysine residue of SEQ ID NO: 4 is linked to a beta-alanine moiety, and
b) wherein a side chain of at least one lysine residue of SEQ ID NO: 6 is linked to a beta-alanine moiety.

C16. The immunogenic composition according to clause C15, wherein a side chain of a second lysine residue of SEQ ID NO: 4 is linked to a side chain of an aspartic acid residue or to a side chain of a glutamic acid residue, and wherein a second lysine residue of SEQ ID NO: 6 is linked to a side chain of an aspartic acid residue or to a side chain of a glutamic acid residue.

C17. The immunogenic composition according to any of clause C12-C16, wherein a side chain of an aspartic acid residue or a side chain of a glutamic acid residue of the polypeptide having the amino acid sequence set forth in SEQ ID NO: 4, wherein the methionine residue at position 1 is optionally not present, is linked to a glycine moiety.

C18. The immunogenic composition according to any of clause C12-C16, wherein a side chain of an aspartic acid residue or a side chain of a glutamic acid residue of the polypeptide having the amino acid sequence set forth in SEQ ID NO: 6, wherein the methionine residue at position 1 is optionally not present, is linked to a glycine moiety.

C19. The immunogenic composition according to any of clause C12-C18, wherein the polypeptide has an EC50 of at least about 100 μg/ml.

C20. An immunogenic composition including an isolated polypeptide having the amino acid sequence set forth in SEQ ID NO: 84 and an isolated polypeptide having the amino acid sequence set forth in SEQ ID NO: 86, wherein each polypeptide includes
a) at least one crosslink between a side chain of an aspartic acid residue of the polypeptide and a side chain of a lysine residue of the polypeptide;
b) at least one crosslink between a side chain of a glutamic acid residue of the polypeptide and a side chain of a lysine residue of the polypeptide;
c) a beta-alanine moiety linked to a side chain of at least one lysine residue of the polypeptide; and
d) a glycine moiety linked to a side chain of at least one aspartic acid residue of the polypeptide or to a side chain of at least one glutamic acid residue of the polypeptide.

C21. An immunogenic composition including a mutant *Clostridium difficile* toxin A, which includes a glucosyltransferase domain having at least one mutation and a cysteine protease domain having at least one mutation, relative to the corresponding wild-type *Clostridium difficile* toxin A.

C22. The composition according to clause C21, wherein the mutation is a non-conservative amino acid substitution.

C23. The composition according to clause C22, wherein the substitution includes an alanine substitution.

C24. The composition according to any of clause C21-C23, wherein the wild-type *Clostridium difficile* toxin A includes a sequence having at least 95% identity to SEQ ID NO: 1.

C25. The composition according to clause C24, wherein the wild-type *Clostridium difficile* toxin A includes a sequence having at least 98% identity to SEQ ID NO: 1.

C26. The composition according to clause C25, wherein the wild-type *Clostridium difficile* toxin A includes SEQ ID NO: 1.

C27. The composition according to any of clause C21-C26, wherein the glucosyltransferase domain includes at least two mutations.

C28. The composition according to clause C27, wherein the at least two mutations are present at amino acid positions 101, 269, 272, 285, 287, 269, 272, 460, 462, 541, or 542, according to the numbering of SEQ ID NO: 1.

C29. The composition according to any of clause C21-C26, wherein the glucosyltransferase domain includes SEQ ID NO: 29.

C30. The composition according to clause C29, wherein the glucosyltransferase domain includes at least two non-conservative mutations present at amino acid positions 101, 269, 272, 285, 287, 269, 272, 460, 462, 541, or 542, or any combination thereof, of SEQ ID NO: 29.

C31. The composition according to any of clause C21-C26, wherein the cysteine protease domain includes a mutation present at positions 700, 589, 655, 543, or any combinations thereof, according to the numbering of SEQ ID NO: 1.

C32. The composition according to any of clause C21-C26, wherein the cysteine protease domain includes SEQ ID NO: 32.

C33. The composition according to clause C32, wherein the cysteine protease domain includes a non-conservative mutation present at positions 1, 47, 113, 158, or any combinations thereof, of SEQ ID NO: 32.

C34. The composition according to clause 21, wherein the mutant *Clostridium difficile* toxin A includes SEQ ID NO: 4.

C35. The composition according to clause 21, wherein the mutant *Clostridium difficile* toxin A includes SEQ ID NO: 84.

C36. The composition according to clause 21, wherein the mutant *Clostridium difficile* toxin A includes SEQ ID NO: 7.
C37. The composition according to clause 21, wherein the mutant *Clostridium difficile* toxin A includes SEQ ID NO: 83.
C38. The composition according to any of clause C21-C33, wherein at least one amino acid of the mutant *Clostridium difficile* toxin A is chemically crosslinked.
C39. The composition according to clause C38, wherein the amino acid is chemically crosslinked by formaldehyde.
C40. The composition according to clause C38, wherein the amino acid is chemically crosslinked by 1-ethyl-3-(3-dimethylaminopropyl) carbodiimide.
C41. The composition according to clause C38 or C40, wherein the amino acid is chemically crosslinked by N-hydroxysuccinimide.
C42. The composition according to any of clause C21-C41, wherein the composition is recognized by an anti-toxin A neutralizing antibody or binding fragment thereof.
C43. An immunogenic composition including a mutant *Clostridium difficile* toxin A, which includes a glucosyltransferase domain including SEQ ID NO: 29 having an amino acid substitution at positions 285 and 287, and a cysteine protease domain including SEQ ID NO: 32 having an amino acid substitution at position 158, relative to the corresponding wild-type *Clostridium difficile* toxin A, wherein at least one amino acid of the mutant *Clostridium difficile* toxin A is chemically crosslinked.
C44. An immunogenic composition including SEQ ID NO: 4 or SEQ ID NO: 7, wherein at least one amino acid of SEQ ID NO: 4 or SEQ ID NO: 7 is chemically crosslinked.
C45. The composition according to clause C43 or C44, wherein the at least one amino acid is crosslinked by formaldehyde.
C46. The composition according to clause C43 or C44, wherein the at least one amino acid is crosslinked by 1-ethyl-3-(3-dimethylaminopropyl) carbodiimide.
C47. The composition according to clause C43, C44, or C46, wherein the at least one amino acid is crosslinked by N-hydroxysuccinimide.
C48. The composition according to clause C43 or C44, wherein the composition is recognized by an anti-toxin A neutralizing antibody or binding fragment thereof.
C49. An immunogenic composition including SEQ ID NO: 4.
C50. An immunogenic composition including SEQ ID NO: 84.
C51. An immunogenic composition including SEQ ID NO: 7.
C52. An immunogenic composition including SEQ ID NO: 83.
C53. The composition according to any of clause C49-052, wherein at least one amino acid is chemically crosslinked.
C54. The composition according to any of clause C21-051, wherein the composition exhibits decreased cytotoxicity, relative to the corresponding wild-type *Clostridium difficile* toxin A.
C55. An isolated polypeptide including SEQ ID NO: 84.
C56. An isolated polypeptide including SEQ ID NO: 86.
C57. An isolated polypeptide including SEQ ID NO: 83.
C58. An isolated polypeptide including SEQ ID NO: 85.
C59. An immunogenic composition including a mutant *Clostridium difficile* toxin B, which includes a glucosyltransferase domain having at least one mutation and a cysteine protease domain having at least one mutation, relative to the corresponding wild-type *Clostridium difficile* toxin B.
C60. The composition according to clause C59, wherein the mutation is a non-conservative amino acid substitution.
C61. The composition according to clause C60, wherein the substitution includes an alanine substitution.
C62. The composition according to any of clause C59-C61, wherein the wild-type *Clostridium difficile* toxin B includes a sequence having at least 95% identity to SEQ ID NO: 2.
C63. The composition according to clause C62, wherein the wild-type *Clostridium difficile* toxin B includes a sequence having at least 98% identity to SEQ ID NO: 2.
C64. The composition according to clause C63, wherein the wild-type *Clostridium difficile* toxin B includes SEQ ID NO: 2.
C65. The composition according to any of clause C59-C64, wherein the glucosyltransferase domain includes at least two mutations.
C66. The composition according to clause C65, wherein the at least two mutations are present at amino acid positions 102, 286, 288, 270, 273, 384, 461, 463, 520, or 543, according to the numbering of SEQ ID NO: 2.
C67. The composition according to any of clause C59-C64, wherein the glucosyltransferase domain includes SEQ ID NO: 31.
C68. The composition according to clause C67, wherein the glucosyltransferase domain includes at least two non-conservative mutations present at amino acid positions 102, 286, 288, 270, 273, 384, 461, 463, 520, or 543 of SEQ ID NO: 31.
C69. The composition according to any of clause C59-C64, wherein the cysteine protease domain includes a mutation present at positions 698, 653, 587, 544, or any combinations thereof, according to the numbering of SEQ ID NO: 2.
C70. The composition according to any of clause C59-C64, wherein the cysteine protease domain includes SEQ ID NO: 33.
C71. The composition according to clause C70, wherein the cysteine protease domain includes a non-conservative mutation present at positions 1, 44, 110, 155, or any combinations thereof, of SEQ ID NO: 33.
C72. The composition according to clause C59, wherein the mutant *Clostridium difficile* toxin B includes SEQ ID NO: 6.
C73. The composition according to clause C59, wherein the mutant *Clostridium difficile* toxin B includes SEQ ID NO: 86.
C74. The composition according to clause C59, wherein the mutant *Clostridium difficile* toxin B includes SEQ ID NO: 8.
C75. The composition according to clause C59, wherein the mutant *Clostridium difficile* toxin B includes SEQ ID NO: 85.
C76. The composition according to any of clause C59-C71, wherein at least one amino acid of the mutant *Clostridium difficile* toxin B is chemically crosslinked.
C77. The composition according to clause C76, wherein the amino acid is chemically crosslinked by formaldehyde.
C78. The composition according to clause C76, wherein the amino acid is chemically crosslinked by 1-ethyl-3-(3-dimethylaminopropyl) carbodiimide.
C79. The composition according to clause C76 or C78, wherein the at least one amino acid is crosslinked by N-hydroxysuccinimide.
C80. The composition according to any of clause C59-C79, wherein the composition is recognized by an anti-toxin B neutralizing antibody or binding fragment thereof.
C81. An immunogenic composition including a mutant *Clostridium difficile* toxin B, which includes a glucosyltransferase domain including SEQ ID NO: 31 having an amino acid substitution at positions 286 and 288, and a cysteine protease domain including SEQ ID NO: 33 having an amino acid substitution at position 155, relative to the corresponding wild-type *Clostridium difficile* toxin B, wherein at least one amino acid of the mutant *Clostridium difficile* toxin B is chemically crosslinked.

C82. An immunogenic composition including SEQ ID NO: 6 or SEQ ID NO:8, wherein at least one amino acid of SEQ ID NO: 6 or SEQ ID NO:8 is chemically crosslinked.
C83. The composition according to clause C81 or C82, wherein the at least one amino acid is crosslinked by formaldehyde.
C84. The composition according to clause C81 or C82, wherein the at least one amino acid is crosslinked by 1-ethyl-3-(3-dimethylaminopropyl) carbodiimide.
C85. The composition according to clause C81, C82, or C84, wherein the at least one amino acid is crosslinked by N-hydroxysuccinimide.
C86. The composition according to clause C81 or C82, wherein the composition is recognized by an anti-toxin B neutralizing antibody or binding fragment thereof.
C87. An immunogenic composition including SEQ ID NO: 6.
C88. An immunogenic composition including SEQ ID NO: 86.
C89. An immunogenic composition including SEQ ID NO: 8.
C90. An immunogenic composition including SEQ ID NO: 85.
C91. The composition according to any of clause C59-C89, wherein the composition exhibits decreased cytotoxicity, relative to the corresponding wild-type *Clostridium difficile* toxin B.
C92. An immunogenic composition including SEQ ID NO: 4 and an immunogenic composition including SEQ ID NO: 6, wherein at least one amino acid of each of SEQ ID NOs: 4 and 6 is chemically crosslinked.
C93. An immunogenic composition including SEQ ID NO: 84 and an immunogenic composition including SEQ ID NO: 86, wherein at least one amino acid of each of SEQ ID NOs: 84 and 86 is chemically crosslinked.
C94. The composition according to clause C92 or C93, wherein the at least one amino acid is crosslinked by formaldehyde.
C95. The composition according to clause C92 or C93, wherein the at least one amino acid is crosslinked by 1-ethyl-3-(3-dimethylaminopropyl) carbodiimide.
C96. The composition according to clause C92, C93, or C95, wherein the at least one amino acid is crosslinked by N-hydroxysuccinimide.
C97. A recombinant cell or progeny thereof, including SEQ ID NO: 11, SEQ ID NO: 12, SEQ ID NO: 13, SEQ ID NO: 14, SEQ ID NO: 44, SEQ ID NO: 45, SEQ ID NO: 46, or SEQ ID NO: 47.
C98. A recombinant cell or progeny thereof, including a nucleic acid sequence that encodes SEQ ID NO: 4, SEQ ID NO: 6, SEQ ID NO: 7, or SEQ ID NO: 8.
C99. A recombinant cell or progeny thereof, including a nucleic acid sequence that encodes SEQ ID NO: 84.
C100. A recombinant cell or progeny thereof, including a nucleic acid sequence that encodes SEQ ID NO: 86.
C101. A recombinant cell or progeny thereof, including a nucleic acid sequence that encodes SEQ ID NO: 83.
C102. A recombinant cell or progeny thereof, including a nucleic acid sequence that encodes SEQ ID NO: 85.
C103. The recombinant cell of clause C97 or C98, wherein said cell is derived from a Gram positive bacterium cell.
C104. The recombinant cell of clause C97, C98, or C99, wherein the cell is derived from a *Clostridium difficile* cell.
C105. The recombinant cell of any of clause C97-C104, wherein the cell lacks an endogenous polynucleotide encoding a toxin.
C106. The cell according to any of clause C104, or C105 wherein the cell is derived from a *Clostridium difficile* cell selected from the group consisting of *Clostridium difficile* 1351, *Clostridium difficile* 3232, *Clostridium difficile* 7322, *Clostridium difficile* 5036, *Clostridium difficile* 4811, and *Clostridium difficile* VPI 11186.
C107. The cell according to clause C106, wherein the cell is a *Clostridium difficile* VPI 11186 cell.
C108. The cell according to clause C106, or C107, wherein a sporulation gene of the *Clostridium difficile* cell is inactivated.
C109. The cell according to clause C108, wherein the sporulation gene includes an spoOA gene or an spoIIE gene.
C110. A method of producing a mutant *Clostridium difficile* toxin, including culturing a recombinant cell or progeny thereof under suitable conditions to express a polynucleotide encoding a mutant *Clostridium difficile* toxin, wherein the cell includes the polynucleotide encoding the mutant *Clostridium difficile* toxin, and wherein the mutant includes a glucosyltransferase domain having at least one mutation and a cysteine protease domain having at least one mutation, relative to the corresponding wild-type *Clostridium difficile* toxin.
C111. The method according to clause C110, wherein the cell lacks an endogenous polynucleotide encoding a toxin.
C112. The method according to clause C110, wherein the recombinant cell or progeny thereof includes a cell according to any of clause C97-C111.
C113. The method according to clause C110, further including isolating the mutant *Clostridium difficile* toxin.
C114. The method according to clause C113, further including contacting the isolated mutant *Clostridium difficile* toxin with formaldehyde.
C115. The method according to clause C114, wherein the contacting occurs for at most 14 days.
C116. The method according to clause C115, wherein the contacting occurs for at most 48 hours.
C117. The method according to clause C114, wherein the contacting occurs at about 25° C.
C118. The method according to clause C113, further including contacting the isolated mutant *Clostridium difficile* toxin with ethyl-3-(3-dimethylaminopropyl) carbodiimide.
C119. The method according to clause C118, wherein the contacting occurs for at most 24 hours.
C120. The method according to clause C120, wherein the contacting occurs for at most 4 hours.
C121. The method according to clause C118, wherein the contacting occurs at about 25° C.
C122. The method according to clause C118, further including contacting the isolated mutant *Clostridium difficile* toxin with N-hydroxysuccinimide.
C123. An immunogenic composition produced by the method according to any of clause C110-C122.
C124. A method of producing a neutralizing antibody against a *Clostridium difficile* toxin A, including administering an immunogenic composition to a mammal, said immunogenic composition including SEQ ID NO: 4, wherein the methionine residue at position 1 is optionally not present, wherein at least one amino acid of SEQ ID NO: 4 is crosslinked by formaldehyde, 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide, and recovering the antibody from the mammal.
C125. A method of producing a neutralizing antibody against a *Clostridium difficile* toxin A, including administering an immunogenic composition to a mammal, said immunogenic composition including SEQ ID NO: 84, wherein at least one amino acid of SEQ ID NO: 84 is crosslinked by formaldehyde, 1-ethyl-3-(3-dimethylaminopropyl) carbodiimide, N-hydroxysuccinimide, or a combination of 1-ethyl-3-(3- dimethylaminopropyl) carbodiimide and N-hydroxysuccinimide, and recovering the antibody from the mammal.

C126. A method of producing a neutralizing antibody against a *Clostridium difficile* toxin B, including administering an immunogenic composition to a mammal, said immunogenic composition including SEQ ID NO: 6, wherein the methionine residue at position 1 is optionally not present, wherein at least one amino acid of SEQ ID NO: 6 is crosslinked by formaldehyde, 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide, and recovering the antibody from the mammal.

C127. A method of producing a neutralizing antibody against a *Clostridium difficile* toxin A, including administering an immunogenic composition to a mammal, said immunogenic composition including SEQ ID NO: 86, wherein at least one amino acid of SEQ ID NO: 86 is crosslinked by formaldehyde, 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide, and recovering the antibody from the mammal.

C128. An antibody or antibody binding fragment thereof specific to an immunogenic composition, said immunogenic composition including SEQ ID NO: 4 wherein the methionine residue at position 1 is optionally not present, or SEQ ID NO: 7 wherein the methionine residue at position 1 is optionally not present.

C129. The antibody or antibody binding fragment thereof according to clause C128, wherein at least one amino acid of SEQ ID NO: 4 wherein the methionine residue at position 1 is optionally not present, or SEQ ID NO: 7 wherein the methionine residue at position 1 is optionally not present, is crosslinked by formaldehyde, 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide.

C130. An antibody or antibody binding fragment thereof including the amino acid sequences of the heavy chain complementarity determining regions (CDRs) set forth in SEQ ID NO: 41 (CDR H1), SEQ ID NO: 42 (CDR H2) and SEQ ID NO: 43 (CDR H3), and the amino acid sequences of the light chain CDRs as shown in SEQ ID NO: 38 (CDR L1), SEQ ID NO: 39 (CDR L2) and SEQ ID NO: 40 (CDR L3).

C131. The antibody or antibody binding fragment thereof according to clause C128, C129, or C130, wherein the antibody or antibody binding fragment thereof includes a heavy chain, which includes the amino acid sequence shown in SEQ ID NO: 37, and a light chain, which includes the amino acid sequence shown in SEQ ID NO: 36.

C132. A composition including a combination of two or more antibodies or antibody binding fragments thereof selected from any according to any of clause C128-C131.

C133. An antibody or antibody binding fragment thereof specific to an immunogenic composiiton, said immunogenic composition including SEQ ID NO: 6 wherein the methionine residue at position 1 is optionally not present, or SEQ ID NO: 8 wherein the methionine residue at position 1 is optionally not present.

C134. The antibody or antibody binding fragment thereof according to clause C133, wherein at least one amino acid of SEQ ID NO: 6 wherein the methionine residue at position 1 is optionally not present, or SEQ ID NO: 8 wherein the methionine residue at position 1 is optionally not present, is crosslinked by formaldehyde, 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide.

C135. An antibody or antibody binding fragment thereof including the amino acid sequences of the heavy chain complementarity determining regions (CDRs) set forth in SEQ ID NO: 51 (CDR H1), SEQ ID NO: 52 (CDR H2) and SEQ ID NO: 53 (CDR H3), and the amino acid sequences of the light chain CDRs as shown in SEQ ID NO: 57 (CDR L1), SEQ ID NO: 58 (CDR L2) and SEQ ID NO: 59 (CDR L3).

C136. An antibody or antibody binding fragment thereof including the amino acid sequences of the heavy chain complementarity determining regions (CDRs) set forth in SEQ ID NO: 61 (CDR H1), SEQ ID NO: 62 (CDR H2) and SEQ ID NO: 63 (CDR H3), and the amino acid sequences of the light chain CDRs as shown in SEQ ID NO: 68 (CDR L1), SEQ ID NO: 69 (CDR L2) and SEQ ID NO: 70 (CDR L3).

C137. An antibody or antibody binding fragment thereof including the amino acid sequences of the heavy chain complementarity determining regions (CDRs) set forth in SEQ ID NO: 73 (CDR H1), SEQ ID NO: 74 (CDR H2) and SEQ ID NO: 75 (CDR H3), and the amino acid sequences of the light chain CDRs as shown in SEQ ID NO: 79 (CDR L1), SEQ ID NO: 80 (CDR L2) and SEQ ID NO: 81 (CDR L3).

C138. A composition including a combination of two or more antibodies or antibody binding fragments thereof selected from any of clause C133-C137.

C139. A method of treating a *Clostridium difficile* infection in a mammal, including administering to the mammal an immunogenic composition including SEQ ID NO: 4 wherein the methionine residue at position 1 is optionally not present, and an immunogenic composition including SEQ ID NO: 6 wherein the methionine residue at position 1 is optionally not present, wherein at least one amino acid of each of SEQ ID NOs: 4 and 6 is crosslinked by formaldehyde.

C140. A method of treating a *Clostridium difficile* infection in a mammal, including administering to the mammal an immunogenic composition including SEQ ID NO: 4 wherein the methionine residue at position 1 is optionally not present, and an immunogenic composition including SEQ ID NO: 6 wherein the methionine residue at position 1 is optionally not present, wherein at least one amino acid of each of SEQ ID NO: 4 and SEQ ID NO: 6 is crosslinked by 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide.

C141. A method of treating a *Clostridium difficile* infection in a mammal, including administering to the mammal an immunogenic composition including SEQ ID NO: 84, and an immunogenic composition including SEQ ID NO: 86, wherein at least one amino acid of each of SEQ ID NO: 84 and SEQ ID NO: 86 is crosslinked by 1-ethyl-3-(3-dimethylaminopropyl) carbodiimide and N-hydroxysuccinimide.

C142. A method of inducing an immune response to *Clostridium difficile* in a mammal, including administering to the mammal an immunogenic composition including SEQ ID NO: 4 wherein the methionine residue at position 1 is optionally not present, and an immunogenic composition including SEQ ID NO: 6 wherein the methionine residue at position 1 is optionally not present, wherein at least one amino acid of each of SEQ ID NO: 4 and SEQ ID NO: 6 is crosslinked by formaldehyde.

C143. A method of inducing an immune response to *Clostridium difficile* in a mammal, including administering to the mammal an immunogenic composition including SEQ ID NO: 4 wherein the methionine residue at position 1 is optionally not present, and an immunogenic composition including SEQ ID NO: 6 wherein the methionine residue at position 1 is optionally not present, wherein at least one amino acid of each of SEQ ID NO: 4 and SEQ ID NO: 6 is crosslinked by 1-ethyl-3-(3-dimethylaminopropyl) carbodiimide, N-hydroxysuccinimide, or a combination of 1-ethyl-3-(3-dimethylaminopropyl) carbodiimide and N-hydroxysuccinimide.

C144. A method of inducing an immune response to *Clostridium difficile* in a mammal, including administering to the mammal an immunogenic composition including SEQ ID NO: 84, and an immunogenic composition including SEQ ID NO: 86, wherein at least one amino acid of each of SEQ ID NO: 84 and SEQ ID NO: 86 is crosslinked by 1-ethyl-3-(3-dimethylaminopropyl) carbodiimide and N-hydroxysuccinimide.

C145. The method according to any of clause C139-C144, wherein the mammal is a mammal in need thereof.

C146. The method according to any of clause C139-C144, wherein the mammal has a recurring *Clostridium difficile* infection.

C147. The method according to any of clause C139-C144, wherein the composition is administered parenterally.

C148. The method according to any of clause C139-C144, wherein the composition further includes an adjuvant.

C149. The method according to clause C148, wherein the adjuvant includes aluminum.

C150. The method according to clause C148, wherein the adjuvant includes aluminum hydroxide gel and a CpG oligonucleotide.

C151. The method according to clause C148, wherein the adjuvant includes ISCOMATRIX®.

SEQUENCE LISTING (177 sequences)

SEQ ID NO: 1 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 2 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 3 - protein, 2710 aa, Artificial
  Synthetic amino acid sequence: TcdA (D285A D287A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 4 - protein, 2710 aa, Artificial
  Synthetic amino acid sequence: TcdA (D285A D287A C700A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 5 - protein, 2366 aa, Artificial
  Synthetic amino acid sequence: TcdB (D286A D288A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 6 - protein, 2366 aa, Artificial
  Synthetic amino acid sequence: TcdB (D286A D288A C698A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 7 - protein, 2710 aa, Artificial
  Synthetic amino acid sequence: TcdA (D269A, R272A, D285A, D287A, E460A, R462A, and C700A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASAIVALLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPAAASTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 8 - protein, 2366 aa, Artificial
  Synthetic amino acid sequence: TcdB (D270A, R273A, D286A, D288A, D461A, K463A, and C698A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 9 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 10 - DNA, 7101 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 11 - DNA, 8133 bp, Artificial
  Synthetic nucleotide sequence: TcdA gene (D285A D287A mutations)
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 12 - DNA, 8133 bp, Artificial
  Synthetic nucleotide sequence: TcdA gene (D285A D287A  C700A mutations)
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggagctaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 13 - DNA, 7101 bp, Artificial
  Synthetic nucleotide sequence: TcdB (D286A D288A mutations)
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 14 - DNA, 7101 bp, Artificial
  Synthetic nucleotide sequence: TcdB (D286A D288A C698A mutations)
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggagctaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 15 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 16 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaaattcaagcagaaatagagcactctctaatctaaaaaaagatatattaaaagaagtaattcttattaaaaattccaatacaagtcctgtagaaaaaaatttacattttgtatggataggtggagaagtcagtgatattgctcttgaatacataaaacaatgggctgatattaatgcagaatataatattaaactgtggtatgatagtgaagcattcttagtcaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactttattagaatcatatagaacaaattctttgagaaaaataaatagtaatcatgggatagatatcagggctaatagtttgtttacagaacaagagttattaaatatttatagtcaggagttgttaaatcgtgggaatttagctgcagcatctgacatagtaagattattagccctaaaaaattttggcggagtatatttagatgttgatatgcttccaggtattcactctgatttatttaaaacaatacctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgacaataacttcacagatactactaagatttttcatgattcactatttaattcagctaccgcagaaaactctatgtttttaacaaaaatagcaccatacttacaagtaggttttatgccagaagctcgctccacaataagtttaagtggtccaggagcttatgcatcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagttactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttgcttggatgtaatatgtttagttatgattttaatgttgaagaaacttatcctggtaagttactattaagtattatggacaaaattacttccactttacctgatgtaaataaagattctattactataggagcaaatcaatatgaagtaagaattaatagtgagggaagaaaagaacttctagctcactcaggtaaatggataaataaagaggaagctattatgagcgatttatctagtaaagaatacattttttttgattccatagataataagctaaaagcaaagtccaagaatattccaggtttagcgtcaatatcagaagatataaaaacattattacttgatgcaagtgttagtcctgatacaaaatttattttaaataatcttaagcttaatattgaatcttctattggtgattacatttattatgaaaaattagaacctgttaaaaatataatccacaattctatagatgatttaatagatgagttcaatctacttgaaaatgtatctgatgaattatatgaattaaaaaaattaaataatctagatgagaagtatttaatatcttttgaagatatctcaaaaaataattcaacttattctgtaagatttattaacaaaagtaatggtgaatcagtttatgtagagacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaactagaagctaaggtgggtgttttagcaataaatatgtcattatctatagctgcaacggtagcttcaattgttggaataggtgctgaagttactattttcttattacctatagctggtatatctgcgggaataccttcattagttaataatgaattaatattgcatgataaggcaacttcagtggtaaactattttaatcatttgtctgaatctaaagaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatatataagctctcatattccttcattatcagtttattctgcaataggtataaaaacagaaaatctagatttttcaaaaaaaataatgatgttaccaaatgctccttcaagagtgttttggtgggaaactggagcagttccaggtttaagatcattggaaaataatgggactaaattgcttgattcaataagagatttatacccaggcaaattttactggagattctatgcctttttcgattatgcaataactacattaaaaccagtgtatgaagacactaatactaaaattaaactagataaagatactagaaactttataatgccaactataactactgacgaaattagaaacaaattatcttattcatttgatggagcaggaggaacttactctttattattatcttcatatccaatatcaatgaatataaatttatctaaagatgatttatggatatttaatattgataatgaagtaagagaaatatctatagaaaatggtactattaaaaaaggaaatttaatagaagatgttttaagtaaaattgatataaataaaaataaacttattataggcaatcaaacaatagatttttcaggtgatatagataacaaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcttacaattacactgatgaatctaataataaatattttggagctatatctaaaacaagtcaaaaaagcataatacattataaaaaagacagtaaaaatatattagaattttataatggcagtacattagaatttaacagtaaagactttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttgaacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatctaacttagtaactggatggcaaactatcaatggtaaaaaatattattttgatataaatactggagcagcttcaactagttataaaattattaatggtaaacacttttattttaataataatggtgtgatgcagttaggagtatttaaaggacctgatggatttgagtattttgcacctgccaatactcagaataataacatagaaggtcaggctatagtttatcaaagtaaattcttaactttgaatggcaaaaaatattattttgataatgactcaaaagcagtcactggatggaggattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtggctctaatggatttgaatatttcgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaagtattactttaatactaacactgctgaagcagctactggatggcaaactattgatggtaaaaaatattactttaatactaacacttctatagcttcaactggttatacaattattaatggtaaatatttttattttaatactgatggtattatgcagataggagtgtttaaagtacctaatggatttgaatactttgcacctgctaatactcataataataacatagaaggtcaagctatactttaccaaaataaattcttaactttgaatggtaaaaaatattactttggtagtgactcaaaagcaattactggatggcaaaccattgatggtaaaaaatattactttaatcctaataatgctattgctgcgactcatctatgcactataaataacgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcataataataacatagaaggtcaggctatagtttaccagaataaattcttaactttgaatggcaaaaaatattattttgataatgactcaaaagcagttactggatggcaaactattgatagtaaaaaatattactttaatcttaacactgctgttgcagttactggatggcaaactattgatggtgaaaaatattactttaatcttaacactgctgaagcagctactggatggcaaactattgatggtaaaagatactactttaatactaacacttatatagcttcaactggttatacgattattaatggtaaacatttttattttaatactgatggtattatgcagataggagtgtttaaaggacctgatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttatatagcttcaactggttatacaattattagtggtaaacatttttattttaatactgatggtattatgcagataggagtgtttaaaggacctgatggatttgaatactttgcacctgctaatacggatgctaacaacatagaaggtcaagctatacgttatcaaaatagattcctatatttacatgacaatatatattactttggcaatgattcaaaagcggctactggttgggcaactattgatggtaatagatattacttcgagcctaatacagctatgggtgcgaatggttataaaactattgataataaaaatttttactttagaaatggtttacctcagataggagtgtttaaaggacctaatggatttgaatactttgcacctgctaatacggatgctaacaatatagatggtcaagctatacgttatcaaaatagattcctacatttacttggaaaaatatattactttggtaataactcaaaagcagttactggatggcaaactattaatagtaaagtatattactttatgcctgatactgctatggctgcagctggtggacttttcgagattgatggtgttatatatttctttggtgttgatggagtaaaagcccctgggatatatggctaa

SEQ ID NO: 17 - protein, 2710 aa, Clostridium difficile; identical to SEQ ID NO: 15

SEQ ID NO: 18 - DNA, 8133 bp, Clostridium difficile; identical to SEQ ID NO: 16

SEQ ID NO: 19 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 20 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataataactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggattgcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatacggatgctaacaacatagaaggtcaagctatactttaccaaaataaattcttaactttgaatggtaaaaaatattactttggtagtgactcaaaagcagttaccggactgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcggctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 21 - protein, 2366 aa, Clostridium difficile
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 22 - DNA, 7101 bp, Clostridium difficile
atgagtttagttaatagaaaacagttagaaaaaatggcaaatgtaagatttcgtgttcaggaagatgaatatgtagcaatattggatgctttagaagaatatcataatatgtcagagaatactgtagtcgaaaaatatttaaaattaaaagatataaatagtttaacagatatttatatagatacatataaaaagtctggtagaaataaagccttaaaaaaatttaaggaatacctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactatagtagaatcagcaacaaatgatacacttgaatcatttagagaaaacttaaatgaccctagatttgactataataaattttacagaaaacgtatggagataatctatgataagcagaaaaatttcataaattactataaaactcaaagagaagaaaatcctgaccttataattgatgatattgtaaagatatatctttcaaacgagtattcaaaggatatagatgaacttaattcctatattgaagagtcattaaataaagttacagaaaatagtgggaatgatgttagaaactttgaagaatttaaaggtggagagtcattcaaattatatgaacaagagttggtagaaagatggaatttggcagctgcttctgacatattaagaatatctgccttaaaagaagttggtggtgtatatttagatgttgatatgttaccaggaatacaaccagacctatttgagtctatagagaaacctagttcagtaacagtggatttttgggaaatggtaaaattagaagctataatgaaatacaaagaatacataccaggatatacttcagagcattttgatatgttggatgaagaagttcaaagtagttttgaatctgttctagcttctaagtcagataagtcagaaatattctcatcacttggcgatatggaggcatcaccactagaagttaaaattgcatttaatagtaaaggtattataaatcaaggactaatttctgtgaaagactcatattgtagcaatttaatagtaaaacaaatcgagaacagatataagatattgaataatagtttaaatccagctattagcgaggataacgatttcaatactacaacgaatgcttttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggtagtatgaatatccatttgatagaagctgacttaagaaactttgaaatctctaaaactaatatttctcaatcaactgaacaagaaatggctagcttatggtcatttgacgatgcaagagctaaagctcaatttgaagaatacaaaaaaaattactttgaaggttctcttggagaagatgacaatcttgacttttctcaaaatacagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggtcttgatgtagattcattatccacagaaatagaaacagcaatagatttagctaaagaggatatttctcctaagtcaatagaaataaacttactgggatgtaacatgtttagctattctgtaaatgtagaggagacttatcctgggaaattattacttagagttaaagataaagtatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattatagtaaaatctaaaaatttacctgaattatctacattattacaagaaattagaaacaattctaattcaagtgatattgaactagaagaaaaagtaatgttagcagaatgtgagataaatgttatttcaaatatagatacacaagtggtagaaggaaggattgaagaagctaaaagcttaacttctgactctattaattatataaagaatgaatttaaactaatagaatctatttctgatgcactatacgatttaaaacaacagaatgaattagaagagtctcattttatatcttttgaggatatattggagactgatgaaggctttagtataagatttattgataaagaaactggagaatctatatttgtagaaactgaaaaggcaatattctctgaatatgctaatcatataactgaagagatttctaagataaaaggtactatatttgatactgtaaatggtaagttagtaaaaaaagtaaatttagatgctacacatgaagtgaatactttaaatgctgcattttttatacaatcattaatagaatataatagttctaaagaatctcttagtaatttaagtgtagcaatgaaagttcaagtttatgctcaattatttagtactggtttaaatactattacagatgcagccaaagttgttgaattagtatcaactgcattagatgaaactatagatttacttcctacattatctgaaggattacctgtaattgcaactatcatagatggtgtaagtttaggtgcagcaatcaaagagctaagtgaaacaagtgacccattattaagacaagaaatagaagctaagataggtataatggcagtaaatttaacagcagctacaactgcaatcattacttcatctttaggaatagctagtggatttagtatacttttagttcctttagcaggaatttcagcaggtataccaagtttagtaaacaatgagcttatcctaagagataaagcaacaaaagttgtagattattttagtcatatatcattagctgagtctgaaggagcatttacttcattagatgataaaataatgatgccacaagatgatttagtaatatctgagatagactttaataacaattcaataactttaggtaaatgtgaaatctggagaatggaaggtggctcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagctttatagtcccagtgataactacagaatatataagagagaaattatcatattctttttatggttctggaggaacttatgcattatctctttctcaatacaatatgaatataaacatagaattaaatgaaaatgatacttgggttatagatgtcgacaatgtcgtaagagatgtcactatagaatctgataaaattaaaaaaggagatttaatagagaatattttatctaaattaagtattgaagacaataaaattattttagataatcatgaaattaatttctctggaacattaaatggaggtaatggatttgtatctttaacattctcaatcttagaaggaataaatgcagttatagaagttgatttattatctaaatcatataaagttcttatttctggtgaactaaaaacattgatggcaaattcaaattctgttcaacagaaaatagattatataggattgaacagcgaattacaaaaaaatataccttatagttttatggatgataaaggaaaagaaaatggatttattaattgttctacaaaagaaggtttatttgtatctgaattatctgatgtagttcttataagtaaagtttatatggacaatagtaaacctctatttggatattgtagtaatgatttgaaagatgttaaagtcataactaaagatgacgttattatattaacaggatattatttaaaagatgatataaaaatctctctttcttttactatacaagatgaaaatactataaaattaaatggagtatatttagatgaaaatggagtagctgaaatattgaaatttatgaataaaaaaggtagtacaaatacttcagattctttaatgagctttttagaaagtatgaatataaaaagtattttcataaattccttacaatctaatactaagcttatattagatactaattttataataagtggtactacttctattggtcaatttgagtttatttgtgataaagataataatatacaaccatatttcattaagtttaatacactagaaactaaatatactctatatgtaggtaatagacaaaatatgatagtagaaccaaattatgatttagatgattctggagatatatcttcaactgtcattaatttttctcagaaatacctttatggaatagacagttgtgttaataaagttataatttcgccaaatatatatacagatgaaataaacataacacctatatatgaagcaaataatacttatccagaagtgattgtattagatacaaattatataagtgaaaaaatcaatattaatatcaatgatttatctatacgatatgtatggagtaatgatggaagtgattttattcttatgtcaactgatgaagagaacaaggtatcacaagttaaaataagatttactaatgtttttaaaggtaatactatatcagataagatatcttttaattttagtgataagcaagatgtatctataaataaagttatttcaacatttacaccttcatattatgtggaaggattacttaattatgatttaggtctgatttctttatacaatgagaaattttatattaataactttggaatgatggtgtctggattagtatatattaatgattcattatattatttcaagccaccaataaagaacttgataactggatttacaactataggtgatgataaatactactttaatccagataatggtggagctgcttcagtcggagaaacaataattgatggcaaaaactactacttcagccaaaatggagtgttacaaacaggtgtatttagtacagaagatggatttaaatattttgctccagcagatacacttgatgaaaatctagagggggaagcaattgattttactggcaaactaactattgatgaaaatgtttattattttggagataattatagagcagctatagaatggcaaacattagatgatgaagtgtactattttagtacagatacaggtagagcttttaaagggctaaatcaaataggtgatgataaattctatttcaactctgatggtattatgcaaaaaggatttgttaatataaatgataagacattctattttgatgattctggtgtgatgaagtcaggatatactgaaatagatggaaaatatttttactttgctgagaatggagaaatgcaaataggagtatttaatacagcagatggatttaaatattttgctcatcatgatgaagatttaggaaatgaagaaggtgaagcactttcatattctggtatacttaattttaacaataagatttattattttgatgattcatttacagcagtagttggatggaaggatttagaagatggttcaaaatattactttgatgaagatacagcagaagcatatataggtatctcaataattaatgatggtaaatattattttaatgattctggaatcatgcaaattggatttgtcacaataaataatgaagtattttatttctctgattctggaatagtagaatctggaatgcaaaatatagatgataattatttctatatagacgaaaatggtctagttcaaattggtgtatttgacacttcagatggatataaatactttgcaccagctaatactgtaaatgataatatctatggacaagcagttgaatatagtggtttagttagagttggtgaagatgtatattattttggagaaacatatacaattgagactggttggatatatgatatggaaaatgaaagtgataaatattatttcgatccagaaactaaaaaagcatataaaggtattaatgtaattgatgatataaaatactattttgatgagaatggaataatgagaacaggtcttataacatttgaagataatcattactattttaatgaagatggtattatgcaatatggttatctaaatatagaagataagacgttctactttagtgaagatggtattatgcagattggagtatttaatacaccagatggatttaaatattttgcacatcaaaatactttagatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 23 - protein, 2366 aa, Clostridium difficile; identical to SEQ ID NO: 21

SEQ ID NO: 24 - DNA, 7101 bp, Clostridium difficile; identical to SEQ ID NO: 22

SEQ ID NO: 25 - protein, 2366 aa, Clostridium difficile; identical to SEQ ID NO: 2

SEQ ID NO: 26 - DNA, 7101 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 27 - DNA, 26039 bp, Clostridium difficile
agctagtcttggtgtattgttagcaggattttttaatttgccaattgaattagttgcagccgttggctatgctagtgtctttggtagtgctacaaatactttttttgcacctgtatttataggggcagaagtttttggatacagctatttaccttatttctttgtagtatgcgctatttcatatatatttaatatggataaatctatttattcactacaaaaaatttcaacaaaacaataaataaaacaacataatgtatgattagaagagaaagaatattagagaaaggatagggtaggaatatgttgacaagtttagctttgatttttttattaggaatggcctcgggaggtatttttaagaggataaagttacctaacttattgggaatgttacttacaggaattatattaggtccatatgttttaaatttgattgataattcaatactagatatttcttctgaccttagaaagattgcattgattattatattaacaagggctggattatctttagatataaacgatttgaagaaagtgggaagacctgctgtacttatgtgctttattccagctacttttgaaattatcggaatgatagttttagcaccaaagttactaggcgtttctatattggaagcagcagtcatgggtgcagtagtaggagcagtttctcctgcaattattgtacctaaaatgcttaaattaatggaagaaggttatggtacagaaaaaagtattccacagatgcttttagcaggaacttctatagacgatattttcgtaattgtgatgtttacagtattcacaggattggcacaaggaaatagtatatcagctattagttttttacaaattccagtatcaattatattaggtgtaatagctggagcagtgattggaatctgtttagcagtattttttaagaaggttcatatgagagattctgctaaaggggtgttgcttttaagtatctcatttttaatgataagtttagaaactgctttagagggtattgtgccattttctggattattagcagttatgagtattgggattttccttcagataaaatatcgtgtagttgcaagaagattgtctataaagtattcaaaactatgggttggcgctgaaattctcttgtttgttttggtaggggcaacagtagatataagttatgcatttaaagcaggaattggagctgtaattttaatatttggagttcttttattccgtatgtaggagtattcttctgccttattaagacaaatttgacaataaaggaaagattgttctgtatgattggctatattccaaaggctacagtacaggcagcaataggaggtgtaccacttgcaatggggatggcatctggacaacttattttgacgttagcagttctcgctatacttataactgcacctcttggagcttttggaattgatgtaacttataaaaaattattaacttctgtaaaaggcgagagtaagtaaaaataaagattattttaactggtaagttatattttggaaaaggattatactattgaatacaatataaaaaaatcatttgggagattaagaaggtagaagttaagaacagattttaaggtatgttatgattattagaattgattttgtgaaattattattgtaatatttaattatatagataaagaagcggagtgataactatgtgtttaaaaaaattatcaaaattagagttagttattatgaaatttatttggaatttagatataaaaaccaattcatatgagattattgattatatgaaagaagaacataatttaccagaaaaagtagctttaaaaactttatcaaaactatcaaagaaaaaattcttatatgttcaagaaacaggcaagtgtatgtattatacagttgcaataaaagaaaaggcatatttagagtttatatcaagaaatgtgcaaaatcttttgaagaataattttataaggaatttattagtatcatttcacgaagaggagctaacagaggaaaagataaagtcgttagaaaactgggtagtaaattgggaagaagcttatgtataaatgttattatttttattacaatttagataattttggttttgtaagctctgcaactatttttagatggttgcagagtttatttttattttttattcccttaagcaatacttaaaagtaaacgcatttatatttactaacttcaattacttctaatacttaaattactttttaaaaatattttgatatgtcatctctatagtaatctagaacttgtttctattctttatataaagtttttatgaatgatatatataatattcgttcatttgattaaaaataacaaaatattaaataattctactctgatagtttgttaaaaaaataataaaaaatattaataaacaaaaaaaaaattatcttaagagaggagaatgttataatataaaaaggtttctagatttcataaaagatactattttagtcttgaaaatatttagtttgaaaagattttaatttaatgattgattaagttaaaaatgtgtatgtaataaattttattttatttattgactaaattataaagtttacataattatttaataattatgtaattgttacttgaaaattgatctattttaaaatctagttataacttcaaaaaagactgaaaattaagaaaaaagaaatataaatataaaaatatgtcatatagattttttttattttactttaataaaatgatttgtttttacaatactttattaatataaagtttattgctaaaatactttatttattagaaaaagattactaattaattattaaaattaatgtattcataatgcatattttcatataaaatttaatttatttgccgattatataattataattactgatttaattccaatgttgttcaaaattttcaaataaagcatcattataaatataagagagggtgattttatgcaaaagtctttttatgaattaattgttttagcaagaaataactcagtagatgatttgcaagaaattttatttatgtttaagccattagtaaaaaaacttagtagagttttacattatgaagagggagaaacagatttaataatattttttattgaattaataaaaaatattaaattaagtagcttttcagaaaaaagcgatgctattatagtcaaatatattcataaatcattactgaataagacttttgagttgtctagaagatattctaaaatgaagtttaattttgtagaatttgatgaaaatatcttaaatatgaaaaataattatcaaagtaagtctgtttttgaggaagatatttgttttttcgaatatattttgaaagaattatctggtattcaaagaaaagttattttttataaatatttaaaaggatattctgatagagaaatatcagtgaaattaaaaatatctagacaagctgttaataaggctaaaaatagagcatttaaaaaaataaaaaaagactatgaaaattattttaacttgtaattaatgagcttaaagagatatttataatagaaatcaaattttagaattaactttattgtaaaatcaataacttaatctaagaatatcttaatttttatattttatatagaacaaagtttacatatttatttcagacaacgtctttattcaatcgaagagcaaattaatcaactgagtgtcttaaatttaaaatgttaggaagtgaatgtatatgaaaacctaagtagatattagtatattttataaatagaaaggaggatatataaaagagttttagcatttagatgtaaaaatattatagtaaaggagaaaattttatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatagataaaaatatgttaaatatatcctcttatacttaaatatataaaaataaacaaaatgatacactacataaagtgttctatctaatatgaagatttaccaataaaaaggtggactatgatgaatgcacagtagttcacctttttatatttctaatggtaacaaaatatttttttatataaacctaggaggcgttatgaatatgacaatatcttttttatcagagcatatatttataaagttagtaattttaactatatcatttgatacattattaggatgtttaagtgcaataaaaagtcgtaaatttaattctagttttggaatagatggaggaatcagaaaagtagcaatgatagcatgtatattttttttatcagtagttgacattcttacaaagtttaactttttatttatgttaccacaagattgtatcaattttttaagactaaaacatcttggaatatctgaatttttctctattttatttattttatatgaaagtgtaagtatattaaaaaatatgtgcttatgtggattaccagtacctaagagattaaaggaaaaaatagcaattttactagatgcaatgacagatgaaatgaatgctaaggatgaaaagtaagtaatggtagatataataaagatattaacaaataaaaagtgttatccaaataagaatagctgaaagttatcataattcatgaaactaataatgaaaacgagggagcagatgccaagagacacacaagtattaaatacatataatttcgaagcaagtgttcattactatatagatgacaaggtagtatatcaaacattggttcacaaagatggtgcatggtcagttggtaaaatctattaagctacattagttacagatatcacaaactataatagttaaacatagaaatatgtgtaaattgtgatggaaattattcaaaaacacaaaaatacgtgatgaaggacaaaatgatatagaaaataagtatcaaaccttaataaatgatttaattgatagtttaaaagttataggaaaaatatataaagaaataaaaacattaaaaaaatataagatatgtttacaaattactatcagacaatctccttatctaatagaagagtcaattaactaattgagtatctttaaattgaaatgttaggaagtgatttaaatatgaaaacttaaattataaaaaatcaatattaatttatttttaaaaaatagaaaggagtgtataagatttattttcaaagtttaaaaacaagaaaatcaatttaaatttcagaaggaataaatgtggttatagaagtggatttattatcaaaaataataatactaggaggtttttatgtctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataataactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggattgcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatacggatgctaacaacatagaaggtcaagctatactttaccaaaataaattcttaactttgaatggtaaaaaatattactttggtagtgactcaaaagcagttaccggactgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcggctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaaaatatatgtttgataaaaaattattcctgtgctactaagaaattatttttatataataaatattgagatttaattaaaagtcatgtgttattgtaatacatgacttttagttaaaatttttctatcatttaataatctattattcttgactattttataataaaattcatatatggaaatattaatactaaataattaatagttgataaaaaatagataatatgctaaaagcaaaaactaatttagagccttgtaactgtttatttgcaattataaaaacatctttaaacatattgactataatataaaatattaactataatacaaaacaatattaattaattttctctacagctatccctggtatagttatatttccacccatagttgattcataagttatagttccagcacttatacctcttatagttatgtaatcatcctctaatactcttgaaggagttattgattttttataactacatagtacaaccttatcataatttccagacacagctaatcttatttgcacctcatcaccatcttcaataacttgaataaccttaccttcaaatttaccttttgtactataatcatcaggtgttctagctaattggtcataagtaataccagtatcatatcctttcttctcctcttcttcttttttgcgttgttcttcagcctttttagcttcttcagcttttttagcttcttcagctttacgttgattttcagcttcaatagctttcttttcgtcgtctttcattttgaaccatggttcagcatcagacaatttgctatttaaagtttctatttctgttttttgagaatctataactgatgtttggttagaaatgacctcctcatggtcttcagaacaagctggtgaggatatattgccaaaaaacacgcctaaaataaatgccagtagagcaataccctttgtgctcttaaagaatttaattattttcttagagcttccttttccttcattactaaattcgttaccctcattttttttagaaaacataatacaatctcccttttattagatatattttattttaaaagttaaaaacttaaaataactagttgactaaaaattatatattcatattttcctaaaatatatttcccctaagcataattttacaaaataaagtaagaagattcaatatattttgaaaaaataagataaaaatgtcagattataatataattttcttgaaggtgaattttatatattaaattaaacataaagtattttatttgtataaaactatattatgatgtaattaagtgactcagtgatttagaggtggtaaaatatatatatatgaaagagcataaataaattgatataataaaaaattaaatattaaatattaactataataaaaaaatatctggtaataggtataatataaaaagaatataccagaaagaaggtgaagtatgggagaactacaaaaaattccaggggtagggaaagcaacagaaaaatctttaatcatgttaggatatacaactattaaatcacttaaagatgcaaacccagcacaaatgtatgaaaaggaatgtttaatgcgtggacagcacatagacagatgtcagttatatgtatacagatgtgcagtatattttgcatcaactgaaaatccagaaccagaaaaattaaagtggtggtattggaaagattaaaaaatcaaaaaagttagacataaaaaagagttgaatatccgttttaaataataaaaactaatactcaactcttttttagtcgtaaattttatgtaaatctatttgtatggctaaatatacccatcaataaatgtataaatataccaatcaacaaatgactaaacatactacctaacaaaggattaaataaattacttaacaaagcattctaaaacaattaattagaaactgtttcttcaagccattttctacattgctcaatatttaccatagggtcaaaaccttggtcttttcccttatttaaaagcatatcacaagggaaagtatcacattcaccacaatgattaagttccttactttcacagcaagttttaaccttacattctccaccccaaaatggtttttccatagttgggcaaccagtgcaatttacttgttctttttttgtacaactgtcacaacagacaccacatcttgattcaaacatgttcaaacatcctttccattatttaaaaatattataaaatgattttagatgaatacaaaagtgcaaatagttgattttaggtcatctaaatgttaaacataaagttattagtactggtaaatttataaaaactattccaaaaatctttttgaatatttcaaaacacaataaattacttcaaatccctttgaatatattttacagcattatagattgctttaaatctctttgaatattctacaagactatagattagtttaaatctctttgagtattctacaagactatagattagtttaaatccctttgaatatttcaaaacaccatagattactttaaattcctttgaatattctataacactataaattacttttaacttttatataaccataaagtttttatctggcactttaaatggagttttatatcaaatttgccttccatcgaataaccaaacttaatttaattacacattccaagagtcaaatattcattcaatatatttgataattctatgttatagctataattaaatatagattattaaagttaaatatttatttaatatattgaatgattttttacctatatttaattaagtttcattatataatataaaaattgtttttgcattaagttttaatataatacataataattttaaataataatattattatatattttttaattttaggagtatatctattatatagcgagtagataaaacatataaaattcaaataaaagatatatatttttaaattaaaatggatatagatttcaactaaaaagaatataaatttcaaacccaaaaatatctagcatttaccattaagaaataacatcattctttctaaaatttctattggcaatttcagaaaatactatagtagtaataaatgcaacacatattgtaactatagtgtcattaacatttaaagcagattgctttataacccccatacgactacctaacatagaataagggaaaaatataccaacagcaggttttgctactattaatcccataccaaatagagaaaggcaaagactaataccaataggagttgcaaaacttctaatctttatagacatgtataattgtatagaagctattgaaatagaaataatccaacctttagcaatccaaccagtcaattctttaggtacactaccagaaaaaccaaacatatttcctgcaactatataaaagataacaaagaaaacttgtgtaatagctgtaagtattgaaactactgtaagtttagataaaaagatattttttaaattaactggcagtgtcattacattattccaattatgattcatatgttcaagcctacaaatatatgcacaaaagattgcgattaagataggaaagaaaaattccccataaaaaagactaacttgagtccataagctgtaccattcttttttgagtatgccttgatttagataaaaattaccagaaccaatcaacacacttataagtggcaaagctagtaatacataccatataaaagaattttttaactttagaatttctcccaaaactgacttccttaacatttaaatccctcctatacttctttttttaataaatgatttcttccaatataataaattagcattccaattaagaaaactaaaatcgtaatagaaaaattcatatcaattctatagacagatgaacctaaaacattatcataagcataacttaaaggtgataactctaggtaataagaccatataaacaatctacgaataccttgataaaacaaacctgatgtcaaacctataaaactaccaatcatgccaaatgtaattgcaatcatttgatttggaattacagttgcaatccataggtgtagtgcaatgatagcaatacttacaagaattgttcctaatgtgtattttaaaagtaaagatacagaaattgactcaataacccctctaaaatgtccaaacaacacaatagataacacttgcatcaatacaggtatagataccaaaatagcagaacataaaaatttagataaataaatagtatttaaagatgtcacagaagattttaaaagcttccatgtatctcctttatgttctatatcgcttatacgtgatgtaattattgatattaagataggaaagaatagaccatttaaacttgcaaaactcataagcatataggaatattcaaatccacctaacatatctggattacgtgtaatagccctatttgaatttacgatacaccacattatttcaacagctacaaataaaaaggtcatcagaataatcttctttcttttaagtttataaaattctagaccaaggtatttcattataaagtcaccgccttaccagtaattctaagaatatatcttccaagctttttttatgttcttctattctaaatacatctatatttgaatggacaagcataccatttattttagcgacatctgagtcttttaaattttcaatagtcaagtacccatcttgtataagtgacatatatcctttagtatttaatagtttttgtgcagatacaacattcttagttttgatagcaatctgactttgacctctattatgaagttcttttatgctatcttgaaaaaccagttcgccatgatttattattcctattgatgtggcaatttggtcaatttcacttaaaagatggctagagattagaacagtcatcccgtatttttctggtagagattttattaattctctaatttcctcaatccctgctgggtcgagtccatttgtaggttcatcaagtattaataatttgggaaacttcattattgccatagcaatgccaagacgttgcttcatacctaaagaatattgactaacttttttatttttttgattttctaaccttacaatttttaatgcttcatttacattttttttaggtaaatctaagagtctttgcattatggtcatgttttcaagccctgtaagatgaccatagtatgatggagattctatcaaagaacctatatcttttaaaattgatattctatttttttcatttaactctttacctaaaatattaatatttccttgtgtgggtttagcaagtccaagaagcattttaagagtggtagattttccagctccattaggacccaaaaaaccatatacagctccttgtggaactcttaggtctatatcctttactctaaatattttattgtattcctttgaaagtctttgtgttctaattatcatttccatatgtttcatccccttttttaatctgtgcttattgattcttttaacttatatcagtataataacttggttacatttcaattagctgaaatttaccttacaataaccttaaaagtctatttaggcaaagttgtgaaaatgggtatatggtatac

SEQ ID NO: 28 - protein, 193 aa, Clostridium difficile
WIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIH

SEQ ID NO: 29 - protein, 542 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSL

SEQ ID NO: 30 - protein, 193 aa, Clostridium difficile
VWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGI

SEQ ID NO: 31 - protein, 543 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 32 - protein, 267 aa, Clostridium difficile
SEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTL

SEQ ID NO: 33 - protein, 224 aa, Clostridium difficile
GEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEES

SEQ ID NO: 34 - protein, 2710 aa, Artificial
  Synthetic amino acid sequence: mutant C. difficile TcdA
  MISC_FEATURE (101)..(101): Xaa is any amino acid
  MISC_FEATURE (269)..(269): Xaa is any amino acid
  MISC_FEATURE (272)..(272): Xaa is any amino acid
  MISC_FEATURE (285)..(285): Xaa is any amino acid
  MISC_FEATURE (287)..(287): Xaa is any amino acid
  MISC_FEATURE (460)..(460): Xaa is any amino acid
  MISC_FEATURE (462)..(462): Xaa is any amino acid
  MISC_FEATURE (541)..(541): Xaa is any amino acid
  MISC_FEATURE (542)..(542): Xaa is any amino acid
  MISC_FEATURE (543)..(543): Xaa is any amino acid
  MISC_FEATURE (589)..(589): Xaa is any amino acid.
  MISC_FEATURE (655)..(655): Xaa is any amino acid.
  MISC_FEATURE (700)..(700): Xaa is any amino acid.
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVXIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASXIVXLLALKNFGGVYLXVXMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPXAXSTISLSGPGAYASAYYDFINLQENTIEKTLKASDLIEFKFPENNLSQLTEQEINSLWSFDQASAKYQFEKYVRDYTGGXXXEDNGVDFNKNTALDKNYLLNNKIPSNNVEEAGSKNYVHYIIQLQGXDISYEATCNLFSKNPKNSIIIQRNMNESAKSYFLSDDGESILELNKYRIPERLKNKEKVKVTFIGXGKDEFNTSEFARLSVDSLSNEISSFLDTIKLDISPKNVEVNLLGXNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 35 - protein, 2366 aa, Artificial
  Synthetic amino acid sequence: mutant C. difficile TcdB
  MISC_FEATURE (102)..(102): Xaa is any amino acid.
  MISC_FEATURE (270)..(270): Xaa is any amino acid.
  MISC_FEATURE (273)..(273): Xaa is any amino acid.
  MISC_FEATURE (286)..(286): Xaa is any amino acid.
  MISC_FEATURE (288)..(288): Xaa is any amino acid.
  MISC_FEATURE (384)..(384): Xaa is any amino acid.
  MISC_FEATURE (520)..(520): Xaa is any amino acid.
  MISC_FEATURE (543)..(543): Xaa is any amino acid.
  MISC_FEATURE (544)..(544): Xaa is any amino acid.
  MISC_FEATURE (587)..(587): Xaa is any amino acid.
  MISC_FEATURE (600)..(600): Xaa is any amino acid.
  MISC_FEATURE (653)..(653): Xaa is any amino acid.
  MISC_FEATURE (698)..(698): Xaa is any amino acid.
  MISC_FEATURE (751)..(751): Xaa is any amino acid.
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASXILXISALKEIGGMYLXVXMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIIXQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLXSFDDARAKAQFEEYKRNYFEGSXXEDDNLDFSQNIVVDKEYLLEKISSLARSSERGYIHYIVQLQGXKISYEAACNLFAXTPYDSVLFQKNIEDSEIAYYYNPGDGEIQEIDKYKIPSIISDRPKIKLTFIGXGKDEFNTDIFAGFDVDSLSTEIEAAIDLAKEDISPKSIEINLLGANMFSYSINVEETYPGKLLLKVKDKISELMPSISQDSIIVSANQYEVRINSEGXRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 36 - protein, 146 aa, Artificial
  Synthetic amino acid sequence: variable light chain of A3-25 mAb IgE
MKLPVRLLVLMFWIPGSSSDVVMTHTPLSLPVSLGDQASMSCRSSQSLIHSNGNTYLHWYLQKPGQSPKLLISKVSNRFSGVPDRFSGSGSGTDFTLKISRVEAEDLGVYFCSQTTYFPYTFGGGTRLEIKRADAAPTVSIFPPSS

SEQ ID NO: 37 - protein, 189 aa, Artificial
  Synthetic amino acid sequence: variable heavy chain of A3-25 mAb IgE
MYLGLNCVFIVFLLKGVQSEVNLEESGGGLVQPGGSMKLSCVASGFTFTNYWMNWVRQSPEKGLEWIAEIRLKSHNYATHFAESVKGRFTISRDDSKSAVSLQMTNLTPEDTGIFYCTWDYYGNPAFVYWGQGTLVTVSAASIRNPQLYPLKPCKGTASMTLGCLVKDYFPGPVTVTWYSDSLNMSTVN

SEQ ID NO: 38 - protein, 16 aa, Artificial
  Synthetic amino acid sequence: CDR1 of the variable light chain of A3-25 mAb
RSSQSLIHSNGNTYLH

SEQ ID NO: 39 - protein, 7 aa, Artificial
  Synthetic amino acid sequence: CDR2 of the variable light chain of A3-25 mAb
KVSNRFS

SEQ ID NO: 40 - protein, 9 aa, Artificial
  Synthetic amino acid sequence: CDR3 of the variable light chain of A3-25 mAb
SQTTYFPYT

SEQ ID NO: 41 - protein, 10 aa, Artificial
  Synthetic amino acid sequence: CDR1 of the variable heavy chain of A3-25 mAb
GFTFTNYWMN

SEQ ID NO: 42 - protein, 19 aa, Artificial
  Synthetic amino acid sequence: CDR2 of the variable heavy chain of A3-25 mAb
EIRLKSHNYATHFAESVKG

SEQ ID NO: 43 - protein, 10 aa, Artificial
  Synthetic amino acid sequence: CDR3 of the variable heavy chain of A3-25 mAb
DYYGNPAFVY

SEQ ID NO: 44 - DNA, 8142 bp, Artificial
  Synthetic nucleotide sequence: TcdA gene (D285A D287A mutations)
catatgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaaagatct

SEQ ID NO: 45 - DNA, 8136 bp, Artificial
  Synthetic nucleotide sequence: TcdA gene (D285A D287A  C700A mutations)
catatgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggagctaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 46 - DNA, 7110 bp, Artificial
  Synthetic nucleotide sequence: TcdB (D286A D288A mutations)
catatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatagagatct

SEQ ID NO: 47 - DNA, 7104 bp, Artificial
  Synthetic nucleotide sequence: TcdB (D286A D288A C698A mutations)
catatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggagctaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 48 - DNA, 21 bp, Artificial Sequence
  Synthetic nucleic acid sequence
tcgtcgtttttcggtgctttt

SEQ ID NO: 49 - protein, 118 aa, Artificial Sequence
  Synthetic amino acid sequence
QVQLQQPGAELVKPGAPVKLSCKASGYSFTSYWMNWVKQRPGRGLEWIGRIDPSNSEIYYNQKFKDKATLTVDKSSSTAYIQLSSLTSEDSAVYYCASGHYGSIFAYWGQGTTLTVSS

SEQ ID NO: 50 - protein, 19 aa, Artificial Sequence
  Synthetic amino acid sequence
MGWSCIILFLVATATGVHS

SEQ ID NO: 51 - protein, 10 aa, Artificial Sequence
  Synthetic amino acid sequence
GYSFTSYWMN

SEQ ID NO: 52 - protein, 15 aa, Artificial Sequence
  Synthetic amino acid sequence
RIDPSNSEIYYNQKF

SEQ ID NO: 53 - protein, 9 aa, Artificial Sequence
  Synthetic amino acid sequence
GHYGSIFAY

SEQ ID NO: 54 - protein, 17 aa, Artificial Sequence
  Synthetic amino acid sequence
AKTTPPSVYPLAPGNSK

SEQ ID NO: 55 - protein, 125 aa, Artificial Sequence
  Synthetic amino acid sequence
VQITQSPSYLAASPGETITINCRASKSISKYLAWYQEKPGKTNKLLLYSGSTLQSGIPSRFSGSRSGTDFTLIISSLEPEDSAMYYCQQHNEYPLTFGAGTKLELKRADAAPTVSIFPPSSEEFQ

SEQ ID NO: 56 - protein, 21 aa, Artificial Sequence
  Synthetic amino acid sequence
MRFQVQVLGLLLLWISGAQCD

SEQ ID NO: 57 - protein, 11 aa, Artificial Sequence
  Synthetic amino acid sequence
RASKSISKYLA

SEQ ID NO: 58 - protein, 7 aa, Artificial Sequence
  Synthetic amino acid sequence
SGSTLQS

SEQ ID NO: 59 - protein, 9 aa, Artificial Sequence
  Synthetic amino acid sequence
QQHNEYPLT

SEQ ID NO: 60 - protein, 121 aa, Artificial Sequence
  Synthetic amino acid sequence
QVQLQQPGAELVKPGASVKLSCKASGYTFTSYWMHWVKQRPGQGLEWIGVINPSNGRSTYSEKFKTTATVTVDKSSSTAYMQLSILTSEDSAVYYCARAYYSTSYYAMDYWGQGTSVTVSS

SEQ ID NO: 61 - protein, 19 aa, Artificial Sequence
  Synthetic amino acid sequence
MGWSYIILFLVATATDVHS

SEQ ID NO: 62 - protein, 10 aa, Artificial Sequence
  Synthetic amino acid sequence
GYTFTSYWMH

SEQ ID NO: 63 - protein, 15 aa, Artificial Sequence
  Synthetic amino acid sequence
VINPSNGRSTYSEKF

SEQ ID NO: 64 - protein, 12 aa, Artificial Sequence
  Synthetic amino acid sequence
AYYSTSYYAMDY

SEQ ID NO: 65 - protein, 17 aa, Artificial Sequence
  Synthetic amino acid sequence
AKTTPPSVYPLAPGNSK

SEQ ID NO: 66 - protein, 130 aa, Artificial Sequence
  Synthetic amino acid sequence
VLMTQSPLSLPVSLGDQASISCRSSQNIVHSNGNTYLEWYLQKPGQSPKLLIYKVSNRFSGVPDRFSGSGSGTYFTLKISRVEAEDLGVYYCFQGSHFPFTFGTGTKLEIKRADAAPTVSIFPPSSEEFQ

SEQ ID NO: 67 - protein, 20 aa, Artificial Sequence
  Synthetic amino acid sequence
MKLPVRLLVLMFWIPASSSD

SEQ ID NO: 68 - protein, 16 aa, Artificial Sequence
  Synthetic amino acid sequence
RSSQNIVHSNGNTYLE

SEQ ID NO: 69 - protein, 7 aa, Artificial Sequence
  Synthetic amino acid sequence
KVSNRFS

SEQ ID NO: 70 - protein, 9 aa, Artificial Sequence
  Synthetic amino acid sequence
FQGSHFPFT

SEQ ID NO: 71 - protein, 118 aa, Artificial Sequence
  Synthetic amino acid sequence
QVQLQQPGAEVVKPGAPVKLSCKASGYPFTNYWMNWVKQRPGRGLEWIGRIDPSNSEIYYNQKFKDKATLTVDKSSSTAYIQLSSLTSEDSAVYYCASGHYGSIFAYWGQGTTLTVSS

SEQ ID NO: 72 - protein, 19 aa, Artificial Sequence
  Synthetic amino acid sequence
MGWSCIILFLVATATGVHS

SEQ ID NO: 73 - protein, 10 aa, Artificial Sequence
  Synthetic amino acid sequence
GYPFTNYWMN

SEQ ID NO: 74 - protein, 15 aa, Artificial Sequence
  Synthetic amino acid sequence
RIDPSNSEIYYNQKF

SEQ ID NO: 75 - protein, 9 aa, Artificial Sequence
  Synthetic amino acid sequence
GHYGSIFAY

SEQ ID NO: 76 - protein, 17 aa, Artificial Sequence
  Synthetic amino acid sequence
AKTTPPSVYPLAPGNSK

SEQ ID NO: 77 - protein, 125 aa, Artificial Sequence
  Synthetic amino acid sequence
VQITQSPSYLAASPGETITINCRASKSISKYLAWYQEKPGKTNKLLIYSGSTLQSGIPSRFSGSRSGTDFTLIISSLEPEDSAMYYCQQHNEYPLTFGAGTKLELKRADAAPTVSIFPPSSEEFQ

SEQ ID NO: 78 - protein, 21 aa, Artificial Sequence
  Synthetic amino acid sequence
MRFQVQVLGLLLLWISGAQCD

SEQ ID NO: 79 - protein, 11 aa, Artificial Sequence
  Synthetic amino acid sequence
RASKSISKYLA

SEQ ID NO: 80 - protein, 7 aa, Artificial Sequence
  Synthetic amino acid sequence
SGSTLQS

SEQ ID NO: 81 - protein, 9 aa, Artificial Sequence
  Synthetic amino acid sequence
QQHNEYPLT

SEQ ID NO: 82 - protein, 2366 aa, Artificial Sequence
  Synthetic amino acid sequence
  MISC_FEATURE (102)..(102): Xaa is any amino acid.
  MISC_FEATURE (270)..(270): Xaa is any amino acid.
  MISC_FEATURE (273)..(273): Xaa is any amino acid.
  MISC_FEATURE (286)..(286): Xaa is any amino acid.
  MISC_FEATURE (288)..(288): Xaa is any amino acid.
  MISC_FEATURE (384)..(384): Xaa is any amino acid.
  MISC_FEATURE (461)..(461): Xaa is any amino acid.
  MISC_FEATURE (463)..(463): Xaa is any amino acid.
  MISC_FEATURE (520)..(520): Xaa is any amino acid.
  MISC_FEATURE (543)..(543): Xaa is any amino acid.
  MISC_FEATURE (544)..(544): Xaa is any amino acid.
  MISC_FEATURE (587)..(587): Xaa is any amino acid.
  MISC_FEATURE (600)..(600): Xaa is any amino acid.
  MISC_FEATURE (653)..(653): Xaa is any amino acid.
  MISC_FEATURE (698)..(698): Xaa is any amino acid.
  MISC_FEATURE (751)..(751): Xaa is any amino acid.
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASXILXISALKEIGGMYLXVXMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIIXQGLISVKDSYCSNLIVKQIENRYKILNNSLNPAISEDNDFNTTTNTFIDSIMAEANADNGRFMMELGKYLRVGFFPXVXTTINLSGPEAYAAAYQDLLMFKEGSMNIHLIEADLRNFEISKTNISQSTEQEMASLXSFDDARAKAQFEEYKRNYFEGSXXEDDNLDFSQNIVVDKEYLLEKISSLARSSERGYIHYIVQLQGXKISYEAACNLFAXTPYDSVLFQKNIEDSEIAYYYNPGDGEIQEIDKYKIPSIISDRPKIKLTFIGXGKDEFNTDIFAGFDVDSLSTEIEAAIDLAKEDISPKSIEINLLGANMFSYSINVEETYPGKLLLKVKDKISELMPSISQDSIIVSANQYEVRINSEGXRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 83 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 84 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 85 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASAIVALLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPAAASTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 86 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 87 - protein, 2710 aa, Clostridium difficile; identical to SEQ ID NO: 15

SEQ ID NO: 88 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 89 - protein, 2710 aa, Clostridium difficile; identical to SEQ ID NO: 15

SEQ ID NO: 90 - protein, 2710 aa, Clostridium difficile; identical to SEQ ID NO: 88

SEQ ID NO: 91 - protein, 2710 aa, Clostridium difficile; identical to SEQ ID NO: 88

SEQ ID NO: 92 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 93 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAETATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 94 - protein, 2710 aa, Clostridium difficile; identical to SEQ ID NO: 92

SEQ ID NO: 95 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 96 - protein, 2710 aa, Clostridium difficile; identical to SEQ ID NO: 15

SEQ ID NO: 97 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 98 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 99 - protein, 2710 aa, Clostridium difficile; identical to SEQ ID NO: 95

SEQ ID NO: 100 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMKIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 101 - protein, 2710 aa, Clostridium difficile; identical to SEQ ID NO: 95

SEQ ID NO: 102 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTLSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 103 - protein, 2710 aa, Clostridium difficile; identical to SEQ ID NO: 102

SEQ ID NO: 104 - protein, 2710 aa, Clostridium difficile; identical to SEQ ID NO: 102

SEQ ID NO: 105 - protein, 2710 aa, Clostridium difficile; identical to SEQ ID NO: 88

SEQ ID NO: 106 - protein, 2710 aa, Clostridium difficile; identical to SEQ ID NO: 92

SEQ ID NO: 107 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 108 - protein, 2710 aa, Clostridium difficile; identical to SEQ ID NO: 88

SEQ ID NO: 109 - protein, 2710 aa, Clostridium difficile; identical to SEQ ID NO: 15

SEQ ID NO: 110 - protein, 2366 aa, Clostridium difficile; identical to SEQ ID NO: 21

SEQ ID NO: 111 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 112 - protein, 2366 aa, Clostridium difficile; identical to SEQ ID NO: 21

SEQ ID NO: 113 - protein, 2366 aa, Clostridium difficile; identical to SEQ ID NO: 111

SEQ ID NO: 114 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYRFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 115 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 116 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 117 - protein, 2366 aa, Clostridium difficile; identical to SEQ ID NO: 115

SEQ ID NO: 118 - protein, 2366 aa, Clostridium difficile; identical to SEQ ID NO: 116

SEQ ID NO: 119 - protein, 2366 aa, Clostridium difficile; identical to SEQ ID NO: 21

SEQ ID NO: 120 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTDYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 121 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTFIGHGKAEFNTDIFAGLDVDSLSSEIETAIGLAKEDISPKSIEINLLGCNMFSYSVNVEETYPGKLLLRVKDKVSELMPSMSQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 122 - protein, 2366 aa, Clostridium difficile; identical to SEQ ID NO: 111

SEQ ID NO: 123 - protein, 2366 aa, Clostridium difficile; identical to SEQ ID NO: 116

SEQ ID NO: 124 - protein, 2366 aa, Clostridium difficile; identical to SEQ ID NO: 115

SEQ ID NO: 125 - protein, 2366 aa, Clostridium difficile; identical to SEQ ID NO: 116

SEQ ID NO: 126 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 127 - protein, 2367 aa, Clostridium difficile; identical to SEQ ID NO: 126

SEQ ID NO: 128 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKDGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 129 - protein, 2366 aa, Clostridium difficile; identical to SEQ ID NO: 111

SEQ ID NO: 130 - protein, 2366 aa, Clostridium difficile; identical to SEQ ID NO: 115

SEQ ID NO: 131 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 132 - protein, 2366 aa, Clostridium difficile; identical to SEQ ID NO: 111

SEQ ID NO: 133 - protein, 2366 aa, Clostridium difficile; identical to SEQ ID NO: 21

SEQ ID NO: 134 - protein, 2710 aa, Clostridium difficile; identical to SEQ ID NO: 88

SEQ ID NO: 135 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 136 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 137 - protein, 2710 aa, Clostridium difficile; identical to SEQ ID NO: 136

SEQ ID NO: 138 - protein, 2710 aa, Clostridium difficile; identical to SEQ ID NO: 88

SEQ ID NO: 139 - protein, 2710 aa, Clostridium difficile; identical to SEQ ID NO: 97

SEQ ID NO: 140 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPNTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 141 - protein, 2366 aa, Clostridium difficile; identical to SEQ ID NO: 111

SEQ ID NO: 142 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 143 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 144 - protein, 2366 aa, Clostridium difficile; identical to SEQ ID NO: 143

SEQ ID NO: 145 - protein, 2366 aa, Clostridium difficile; identical to SEQ ID NO: 143

SEQ ID NO: 146 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 147 - protein, 2366 aa, Clostridium difficile; identical to SEQ ID NO: 146

SEQ ID NO: 148 - protein, 2710 aa, Clostridium difficile; identical to SEQ ID NO: 88

SEQ ID NO: 149 - protein, 2710 aa, Clostridium difficile; identical to SEQ ID NO: 88

SEQ ID NO: 150 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 151 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 152 - protein, 2710 aa, Clostridium difficile; identical to SEQ ID NO: 98

SEQ ID NO: 153 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 154 - protein, 2710 aa, Clostridium difficile; identical to SEQ ID NO: 88

SEQ ID NO: 155 - protein, 2710 aa, Clostridium difficile; identical to SEQ ID NO: 98

SEQ ID NO: 156 - protein, 2710 aa, Clostridium difficile; identical to SEQ ID NO: 151

SEQ ID NO: 157 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYENTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTSIASTGYTSINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 158 - protein, 2366 aa, Clostridium difficile; identical to SEQ ID NO: 111

SEQ ID NO: 159 - protein, 2366 aa, Clostridium difficile; identical to SEQ ID NO: 111

SEQ ID NO: 160 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 161 - protein, 2366 aa, Clostridium difficile; identical to SEQ ID NO: 160

SEQ ID NO: 162 - protein, 2366 aa, Clostridium difficile; identical to SEQ ID NO: 160

SEQ ID NO: 163 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 164 - protein, 2366 aa, Clostridium difficile; identical to SEQ ID NO: 163

SEQ ID NO: 165 - protein, 2366 aa, Clostridium difficile; identical to SEQ ID NO: 163

SEQ ID NO: 166 - protein, 2366 aa, Clostridium difficile; identical to SEQ ID NO: 163

SEQ ID NO: 167 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 168 - protein, 2710 aa, Clostridium difficile; identical to SEQ ID NO: 92

SEQ ID NO: 169 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 170 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 171 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 172 - protein, 2710 aa, Clostridium difficile; identical to SEQ ID NO: 171

SEQ ID NO: 173 - protein, 2366 aa, Clostridium difficile; identical to SEQ ID NO: 115

SEQ ID NO: 174 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 175 - protein, 2366 aa, Clostridium difficile; identical to SEQ ID NO: 174

SEQ ID NO: 176 - protein, 2366 aa, Clostridium difficile; identical to SEQ ID NO: 174

SEQ ID NO: 177 - protein, 2366 aa, Clostridium difficile; identical to SEQ ID NO: 174

The invention claimed is:

1. An isolated polypeptide comprising the amino acid sequence set forth in SEQ ID NO: 84, wherein a side chain of a lysine residue of the polypeptide is crosslinked to a beta-alanine moiety.

2. The isolated polypeptide according to claim 1, comprising the amino acid sequence set forth in SEQ ID NO:4, wherein the methionine residue at position 1 is optionally not present.

3. The isolated polypeptide according to claim 1, further comprising a glycine moiety crosslinked to a side chain of an aspartic acid residue of the polypeptide or to a side chain of a glutamic acid residue of the polypeptide.

4. The isolated polypeptide according to claim 1, further comprising a crosslink between a second lysine residue of the polypeptide and a side chain of an aspartic acid residue of the polypeptide.

5. The isolated polypeptide according to claim 1, further comprising a crosslink between a second lysine residue of the polypeptide and a side chain of a glutamic acid residue of the polypeptide.

6. The isolated polypeptide according to claim 1, wherein the polypeptide has an $EC_{50}$ of at least about 100 µg/ml, as measured by an in vitro cytotoxicity assay.

7. The isolated polypeptide according to claim 6, wherein the polypeptide has an $EC_{50}$ of at least about 1000 µg/ml, as measured by an in vitro cytotoxicity assay.

8. An immunogenic composition comprising a first isolated polypeptide having the amino acid sequence set forth in SEQ ID NO: 84 wherein a side chain of a lysine residue of the first polypeptide is crosslinked to a beta-alanine moiety.

9. The immunogenic composition according to claim 8, further comprising a second isolated polypeptide having the amino acid sequence set forth in SEQ ID NO: 86, wherein a side chain of a lysine residue of the second polypeptide is crosslinked to a beta-alanine moiety.

10. The immunogenic composition according to claim 9, said first polypeptide comprising the amino acid sequence set forth in SEQ ID NO: 4, wherein the methionine residue at position 1 is optionally not present, and said second polypeptide comprising the amino acid sequence set forth in SEQ ID NO: 6.

11. The immunogenic composition according to claim 8, further comprising a crosslink between a side chain of a second lysine residue of the first polypeptide and a side chain of an aspartic acid residue.

12. The immunogenic composition according to claim 9, further comprising a crosslink between a side chain of a second lysine residue of the second polypeptide and a side chain of an aspartic acid residue.

13. The immunogenic composition according to claim 8, further comprising a crosslink between a side chain of a second lysine residue of the first polypeptide and a side chain of a glutamic acid residue.

14. The immunogenic composition according to claim 9, further comprising a crosslink between a side chain of a second lysine residue of the second polypeptide and a side chain of a glutamic acid residue.

15. The immunogenic composition according to claim 8, further comprising a crosslink between a side chain of an aspartic acid residue of the first polypeptide and a glycine moiety.

16. The immunogenic composition according to claim 9, further comprising a crosslink between a side chain of an aspartic acid residue of the second polypeptide and a glycine moiety.

17. The immunogenic composition according to claim 8, further comprising a crosslink between a side chain of a glutamic acid residue of the first polypeptide and a glycine moiety.

18. The immunogenic composition according to claim 9, further comprising a crosslink between a side chain of a glutamic acid residue of the second polypeptide and a glycine moiety.

19. The immunogenic composition according to claim 8, wherein each polypeptide has an $EC_{50}$ of at least about 1000 µg/ml, as measured by an in vitro cytotoxicity assay.

20. The immunogenic composition according to claim 8, further comprising an adjuvant.

* * * * *